United States Patent 11,723,967 (ZIKA VIRUS VACCINE) - sequence listing, part 3

SEQ ID NO: 3041 - RNA, 2356 nt, Artificial Sequence
  ZIKV prME variant mRNA Design 1 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3042 - RNA, 2353 nt, Artificial Sequence
  ZIKV prME variant mRNA Design 1 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3043 - RNA, 2350 nt, Artificial Sequence
  ZIKV prME variant mRNA Design 1 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3044 - RNA, 2347 nt, Artificial Sequence
  ZIKV prME variant mRNA Design 1 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3045 - RNA, 2344 nt, Artificial Sequence
  ZIKV prME variant mRNA Design 1 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3046 - RNA, 2341 nt, Artificial Sequence
  ZIKV prME variant mRNA Design 1 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3047 - RNA, 2338 nt, Artificial Sequence
  ZIKV prME variant mRNA Design 1 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3048 - RNA, 2335 nt, Artificial Sequence
  ZIKV prME variant mRNA Design 1 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3049 - RNA, 2332 nt, Artificial Sequence
  ZIKV prME variant mRNA Design 1 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3050 - RNA, 2329 nt, Artificial Sequence
  ZIKV prME variant mRNA Design 1 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3051 - RNA, 2326 nt, Artificial Sequence
  ZIKV prME variant mRNA Design 1 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3052 - RNA, 2323 nt, Artificial Sequence
  ZIKV prME variant mRNA Design 1 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3053 - RNA, 2320 nt, Artificial Sequence
  ZIKV prME variant mRNA Design 1 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3054 - RNA, 2317 nt, Artificial Sequence
  ZIKV prME variant mRNA Design 1 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3055 - RNA, 2314 nt, Artificial Sequence
  ZIKV prME variant mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3056 - RNA, 2314 nt, Artificial Sequence
  ZIKV prME variant mRNA Design 1 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3057 - RNA, 2326 nt, Artificial Sequence
  ZIKV prME variant mRNA Design 1 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3058 - RNA, 2350 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3059 - RNA, 2350 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3060 - RNA, 2341 nt, Artificial Sequence
  ZIKV prME variant mRNA Design 1 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3061 - RNA, 2338 nt, Artificial Sequence
  ZIKV prME variant mRNA Design 1 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3062 - RNA, 2335 nt, Artificial Sequence
  ZIKV prME variant mRNA Design 1 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3063 - RNA, 2332 nt, Artificial Sequence
  ZIKV prME variant mRNA Design 1 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3064 - RNA, 2329 nt, Artificial Sequence
  ZIKV prME variant mRNA Design 1 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3065 - RNA, 2326 nt, Artificial Sequence
  ZIKV prME variant mRNA Design 1 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3066 - RNA, 2323 nt, Artificial Sequence
  ZIKV prME variant mRNA Design 1 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3067 - RNA, 2320 nt, Artificial Sequence
  ZIKV prME variant mRNA Design 1 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3068 - RNA, 2317 nt, Artificial Sequence
  ZIKV prME variant mRNA Design 1 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3069 - RNA, 2314 nt, Artificial Sequence
  ZIKV prME variant mRNA Design 1 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3070 - RNA, 2311 nt, Artificial Sequence
  ZIKV prME variant mRNA Design 1 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3071 - RNA, 2308 nt, Artificial Sequence
  ZIKV prME variant mRNA Design 1 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3072 - RNA, 2305 nt, Artificial Sequence
  ZIKV prME variant mRNA Design 1 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3073 - RNA, 2302 nt, Artificial Sequence
  ZIKV prME variant mRNA Design 1 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3074 - RNA, 2299 nt, Artificial Sequence
  ZIKV prME variant mRNA Design 1 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3075 - RNA, 2296 nt, Artificial Sequence
  ZIKV prME variant mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3076 - RNA, 2296 nt, Artificial Sequence
  ZIKV prME variant mRNA Design 1 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3077 - RNA, 2308 nt, Artificial Sequence
  ZIKV prME variant mRNA Design 1 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3078 - RNA, 2332 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3079 - RNA, 2332 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3080 - RNA, 2332 nt, Artificial Sequence
  ZIKV prME variant mRNA Design 1 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3081 - RNA, 2329 nt, Artificial Sequence
  ZIKV prME variant mRNA Design 1 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3082 - RNA, 2326 nt, Artificial Sequence
  ZIKV prME variant mRNA Design 1 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3083 - RNA, 2323 nt, Artificial Sequence
  ZIKV prME variant mRNA Design 1 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3084 - RNA, 2320 nt, Artificial Sequence
  ZIKV prME variant mRNA Design 1 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3085 - RNA, 2317 nt, Artificial Sequence
  ZIKV prME variant mRNA Design 1 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3086 - RNA, 2314 nt, Artificial Sequence
  ZIKV prME variant mRNA Design 1 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3087 - RNA, 2311 nt, Artificial Sequence
  ZIKV prME variant mRNA Design 1 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3088 - RNA, 2308 nt, Artificial Sequence
  ZIKV prME variant mRNA Design 1 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3089 - RNA, 2305 nt, Artificial Sequence
  ZIKV prME variant mRNA Design 1 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3090 - RNA, 2302 nt, Artificial Sequence
  ZIKV prME variant mRNA Design 1 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3091 - RNA, 2299 nt, Artificial Sequence
  ZIKV prME variant mRNA Design 1 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3092 - RNA, 2296 nt, Artificial Sequence
  ZIKV prME variant mRNA Design 1 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3093 - RNA, 2293 nt, Artificial Sequence
  ZIKV prME variant mRNA Design 1 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3094 - RNA, 2290 nt, Artificial Sequence
  ZIKV prME variant mRNA Design 1 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3095 - RNA, 2287 nt, Artificial Sequence
  ZIKV prME variant mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3096 - RNA, 2287 nt, Artificial Sequence
  ZIKV prME variant mRNA Design 1 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3097 - RNA, 2299 nt, Artificial Sequence
  ZIKV prME variant mRNA Design 1 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3098 - RNA, 2323 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3099 - RNA, 2323 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3100 - RNA, 2329 nt, Artificial Sequence
  ZIKV prME variant mRNA Design 1 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3101 - RNA, 2323 nt, Artificial Sequence
  ZIKV prME variant mRNA Design 1 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3102 - RNA, 2326 nt, Artificial Sequence
  ZIKV prME variant mRNA Design 1 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3103 - RNA, 2320 nt, Artificial Sequence
  ZIKV prME variant mRNA Design 1 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3104 - RNA, 2317 nt, Artificial Sequence
  ZIKV prME variant mRNA Design 1 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3105 - RNA, 2314 nt, Artificial Sequence
  ZIKV prME variant mRNA Design 1 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3106 - RNA, 2311 nt, Artificial Sequence
  ZIKV prME variant mRNA Design 1 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3107 - RNA, 2308 nt, Artificial Sequence
  ZIKV prME variant mRNA Design 1 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3108 - RNA, 2305 nt, Artificial Sequence
  ZIKV prME variant mRNA Design 1 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3109 - RNA, 2302 nt, Artificial Sequence
  ZIKV prME variant mRNA Design 1 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3110 - RNA, 2299 nt, Artificial Sequence
  ZIKV prME variant mRNA Design 1 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3111 - RNA, 2296 nt, Artificial Sequence
  ZIKV prME variant mRNA Design 1 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3112 - RNA, 2293 nt, Artificial Sequence
  ZIKV prME variant mRNA Design 1 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3113 - RNA, 2290 nt, Artificial Sequence
  ZIKV prME variant mRNA Design 1 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3114 - RNA, 2287 nt, Artificial Sequence
  ZIKV prME variant mRNA Design 1 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3115 - RNA, 2284 nt, Artificial Sequence; identical to SEQ ID NO: 3021
  ZIKV (strain ZikaSPH2015) Polyprotein(108-794) mRNA Design 1 wild type

SEQ ID NO: 3116 - RNA, 2284 nt, Artificial Sequence
  ZIKV prME variant mRNA Design 1 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3117 - RNA, 2296 nt, Artificial Sequence
  ZIKV prME variant mRNA Design 1 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3118 - RNA, 2320 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3119 - RNA, 2320 nt, Artificial Sequence
  ZIKV prME variant mRNA Design 1 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3120 - RNA, 2359 nt, Artificial Sequence; identical to SEQ ID NO: 234
  KU321639.1 prME-long mRNA Design 1 wild type

SEQ ID NO: 3121 - RNA, 2359 nt, Artificial Sequence; identical to SEQ ID NO: 238
  KU312312.1 prME-long mRNA Design 1 wild type

SEQ ID NO: 3122 - RNA, 2347 nt, Artificial Sequence; identical to SEQ ID NO: 242
  AY632535.2 prME-long mRNA Design 1 wild type

SEQ ID NO: 3123 - RNA, 2359 nt, Artificial Sequence
  KU527068.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3124 - RNA, 2359 nt, Artificial Sequence
  KU720415.1 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3125 - RNA, 2341 nt, Artificial Sequence
  DQ859059.1 prME-long mRNA Design 1 wild type
gggagaaagcuuaccaugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3126 - RNA, 2359 nt, Artificial Sequence
  KX377335.1 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3127 - RNA, 2359 nt, Artificial Sequence
  LC002520.1 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3128 - RNA, 2347 nt, Artificial Sequence
  KU963573.2 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3129 - RNA, 2359 nt, Artificial Sequence
  KX694534.2 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3130 - RNA, 2359 nt, Artificial Sequence
  KX447520.1 prME-long mRNA Design 1 wild type
gggagaaagcuuaccaugagaauaaucaaugcuaggaaggagaagaagagacgaggcgcagaugcuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3131 - RNA, 2359 nt, Artificial Sequence
  KX369547.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3132 - RNA, 2359 nt, Artificial Sequence
  KX447515.1 prME-long mRNA Design 1 wild type
gggagaaagcuuaccaugagaauaaucaaugcuaggaaggagaagaagagacgaggcgcagauacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3133 - RNA, 2359 nt, Artificial Sequence
  KU501217.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3134 - RNA, 2359 nt, Artificial Sequence
  KU312314.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3135 - RNA, 2359 nt, Artificial Sequence
  KX446950.2 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3136 - RNA, 2359 nt, Artificial Sequence
  KY003157.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3137 - RNA, 2359 nt, Artificial Sequence
  KX811222.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3138 - RNA, 2359 nt, Artificial Sequence
  KX447516.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3139 - RNA, 2359 nt, Artificial Sequence
  KX520666.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3140 - RNA, 2359 nt, Artificial Sequence
  KU729218.1 prME-long mRNA Design 1 wild type
gggagaaagcuuaccaugagaauaaucaaugcuaggaaggagaagaagagacgaagcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3141 - RNA, 2359 nt, Artificial Sequence
  KU761561.1 prME-long mRNA Design 1 wild type
gggagaaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3142 - RNA, 2359 nt, Artificial Sequence
  KY317938.1 prME-long mRNA Design 1 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3143 - RNA, 2359 nt, Artificial Sequence
  KY075939.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3144 - RNA, 2359 nt, Artificial Sequence
  KX806557.2 prME-long mRNA Design 1 wild type
gggagaaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3145 - RNA, 2359 nt, Artificial Sequence
  KU870645.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3146 - RNA, 2359 nt, Artificial Sequence
  KU729217.2 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3147 - RNA, 2359 nt, Artificial Sequence
  KU497555.1 prME-long mRNA Design 1 wild type
gggagaaagcuuaccaugagaauaaucaaugccaggaaggagaagaagagacgaggcgcagauacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3148 - RNA, 2359 nt, Artificial Sequence
  KX087101.3 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3149 - RNA, 2359 nt, Artificial Sequence
  KY075932.1 prME-long mRNA Design 1 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3150 - RNA, 2359 nt, Artificial Sequence
  KY014317.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3151 - RNA, 2359 nt, Artificial Sequence
  KU758876.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3152 - RNA, 2359 nt, Artificial Sequence
  KU758874.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3153 - RNA, 2359 nt, Artificial Sequence
  KY014314.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3154 - RNA, 2359 nt, Artificial Sequence
  KU926310.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3155 - RNA, 2359 nt, Artificial Sequence
  KU761560.1 prME-long mRNA Design 1 wild type
gggagaaagcuuaccaugagaauaaucaaugcugggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacguucaccaagaucccggcugaaacacugcacgggacagucacaguggagguacaguacgcagggacagauggaccuugcaagguuccagcucagauggcgguggacaugcaaacucugaccccaguugggaggcugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3156 - RNA, 2359 nt, Artificial Sequence
  KY317939.1 prME-long mRNA Design 1 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3157 - RNA, 2359 nt, Artificial Sequence
  KY075937.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3158 - RNA, 2359 nt, Artificial Sequence
  LC191864.1 prME-long mRNA Design 1 wild type
gggagaaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3159 - RNA, 2359 nt, Artificial Sequence
  KX447517.1 prME-long mRNA Design 1 wild type
gggagaaagcuuaccaugagaauaaucaaugccaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3160 - RNA, 2359 nt, Artificial Sequence
  KU922923.1 prME-long mRNA Design 1 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3161 - RNA, 2359 nt, Artificial Sequence
  KY003156.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3162 - RNA, 2359 nt, Artificial Sequence
  KU312313.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3163 - RNA, 2359 nt, Artificial Sequence
  KY075935.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3164 - RNA, 2359 nt, Artificial Sequence
  KY014320.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3165 - RNA, 2359 nt, Artificial Sequence
  KX827309.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3166 - RNA, 2359 nt, Artificial Sequence
  KU681081.3 prME-long mRNA Design 1 wild type
gggagaaagcuuaccaugagaauaaucaaugcuaggaaggagaagaagagacgaggcacagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3167 - RNA, 2359 nt, Artificial Sequence
  KU744693.1 prME-long mRNA Design 1 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucaggugguguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3168 - RNA, 2359 nt, Artificial Sequence
  KY328290.1 prME-long mRNA Design 1 wild type
gggagaaagcuuaccaugagaauaaucaaugcuaggaaggagaagaagagacgaggcacagauacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3169 - RNA, 2359 nt, Artificial Sequence
  KX694532.2 prME-long mRNA Design 1 wild type
gggagaaagcuuaccaugagaauaaucaaugccaggaaggagaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuagcagcagcugccaucgcuuggcucuugggaagcucaacgagccaaaaagucauauacuuggucaugauacugcugauugcuccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggcgaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaauucaaggaugcacaugccaaaaggcaaacugucgugguucuagggagucaagagggagcaguucacacggcccuugcuggagcucuggaggcugagauggauggugcaaagggaaggcuguccucuggccacuugaaaugucgccugaaaauggauaaacuuagauugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3170 - RNA, 2359 nt, Artificial Sequence
  KU955593.1 prME-long mRNA Design 1 wild type
gggagaaagcuuaccaugagaauaaucaaugcuaggaaggagaagaagagacgaggcacagauacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3171 - RNA, 2359 nt, Artificial Sequence
  KY272987.1 prME-long mRNA Design 1 wild type
gggagaaagcuuaccaugagaauaaucaaugcuaggaaggaaaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3172 - RNA, 2359 nt, Artificial Sequence
  EU545988.1 prME-long mRNA Design 1 wild type
gggagaaagcuuaccaugagaauaaucaaugcuaggaaggagaagaagagacgaggcacagauacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3173 - RNA, 2359 nt, Artificial Sequence
  KU681082.3 prME-long mRNA Design 1 wild type
gggagaaagcuuaccaugagaauaaucaaugcuaggaaggagaagaagagacgaggcgcagauacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3174 - RNA, 2359 nt, Artificial Sequence
  KX601167.1 prME-long mRNA Design 1 wild type
gggagaaagcuuaccaugagaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3175 - RNA, 2359 nt, Artificial Sequence
  KX694533.2 prME-long mRNA Design 1 wild type
gggagaaagcuuaccaugagaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3176 - RNA, 2359 nt, Artificial Sequence
  KY288905.1 prME-long mRNA Design 1 wild type
gggagaaagcuuaccaugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3177 - RNA, 2359 nt, Artificial Sequence
  KF268950.1 prME-long mRNA Design 1 wild type
gggagaaagcuuaccaugagaauaaucaaugcuaggaaggagaggaagagacguggugcagacaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3178 - RNA, 2359 nt, Artificial Sequence
  KF383121.1 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3179 - RNA, 2341 nt, Artificial Sequence
  KF268949.1 prME-long mRNA Design 1 wild type
gggagaaagcuuaccaugagaauaaucaaugcuaggaaggagaggaagagacguggugcagacaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3180 - RNA, 2359 nt, Artificial Sequence
  KU955595.1 prME-long mRNA Design 1 wild type
gggagaaagcuuaccaugagaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3181 - RNA, 2359 nt, Artificial Sequence
  KF383116.1 prME-long mRNA Design 1 wild type
gggagaaagcuuaccaugagaauuaucaaugcuaggaaggagaggaagagacguggcgcugacaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcugauguugggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3182 - RNA, 2341 nt, Artificial Sequence
  KU963574.2 prME-long mRNA Design 1 wild type
gggagaaagcuuaccaugagaauaaucaaugcuaggaaggagaggaagagacguggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcugaugugggguguucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3183 - RNA, 2341 nt, Artificial Sequence
  KX601166.1 prME-long mRNA Design 1 wild type
gggagaaagcuuaccaugagaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3184 - RNA, 2359 nt, Artificial Sequence
  KF383118.1 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3185 - RNA, 2353 nt, Artificial Sequence
  KF383120.1 prME-long mRNA Design 1 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcagacguggggugcucaguugacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3186 - RNA, 2284 nt, Artificial Sequence
  KU321639.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3187 - RNA, 2284 nt, Artificial Sequence
  KU312312.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3188 - RNA, 2272 nt, Artificial Sequence
  AY632535.2 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3189 - RNA, 2284 nt, Artificial Sequence
  KU527068.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3190 - RNA, 2284 nt, Artificial Sequence
  KX421193.1 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3191 - RNA, 2284 nt, Artificial Sequence
  KX377335.1 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3192 - RNA, 2284 nt, Artificial Sequence
  LC002520.1 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3193 - RNA, 2266 nt, Artificial Sequence
  DQ859059.1 prME-short mRNA Design 1 wild type
gggagaaagcuuaccaugaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3194 - RNA, 2272 nt, Artificial Sequence
  KU963573.2 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3195 - RNA, 2284 nt, Artificial Sequence
  KX694534.2 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3196 - RNA, 2284 nt, Artificial Sequence
  KX369547.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3197 - RNA, 2284 nt, Artificial Sequence
  KX447515.1 prME-short mRNA Design 1 wild type
gggagaaagcuuaccaugacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3198 - RNA, 2284 nt, Artificial Sequence
  KU729218.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3199 - RNA, 2284 nt, Artificial Sequence
  KU501217.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3200 - RNA, 2284 nt, Artificial Sequence
  KU312314.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3201 - RNA, 2284 nt, Artificial Sequence
  KX446950.2 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3202 - RNA, 2284 nt, Artificial Sequence
  KY003157.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3203 - RNA, 2284 nt, Artificial Sequence
  KX811222.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3204 - RNA, 2284 nt, Artificial Sequence
  KX447516.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3205 - RNA, 2284 nt, Artificial Sequence
  KX520666.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3206 - RNA, 2284 nt, Artificial Sequence
  KU497555.1 prME-short mRNA Design 1 wild type
gggagaaagcuuaccaugacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3207 - RNA, 2284 nt, Artificial Sequence
  KY075939.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3208 - RNA, 2284 nt, Artificial Sequence
  KY075932.1 prME-short mRNA Design 1 wild type
gggagaaagcuuaccaugacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3209 - RNA, 2284 nt, Artificial Sequence
  KU870645.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3210 - RNA, 2284 nt, Artificial Sequence
  KU729217.2 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3211 - RNA, 2284 nt, Artificial Sequence
  KX087101.3 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3212 - RNA, 2284 nt, Artificial Sequence
  KY014317.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3213 - RNA, 2284 nt, Artificial Sequence
  KU758876.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3214 - RNA, 2284 nt, Artificial Sequence
  KU758874.1 prME-short mRNA Design 1 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3215 - RNA, 2284 nt, Artificial Sequence
  KY317939.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3216 - RNA, 2284 nt, Artificial Sequence
  KY014314.1 prME-short mRNA Design 1 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3217 - RNA, 2284 nt, Artificial Sequence
  KX447517.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3218 - RNA, 2284 nt, Artificial Sequence
  KU926310.1 prME-short mRNA Design 1 wild type
gggagaaagcuuaccaugacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3219 - RNA, 2284 nt, Artificial Sequence
  KU922923.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3220 - RNA, 2284 nt, Artificial Sequence
  KY075937.1 prME-short mRNA Design 1 wild type
gggagaaagcuuaccaugacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3221 - RNA, 2284 nt, Artificial Sequence
  KY003156.1 prME-short mRNA Design 1 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3222 - RNA, 2284 nt, Artificial Sequence
  KU312313.1 prME-short mRNA Design 1 wild type
gggagaaagcuuaccaugacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3223 - RNA, 2284 nt, Artificial Sequence
  KY075935.1 prME-short mRNA Design 1 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3224 - RNA, 2284 nt, Artificial Sequence
  KY014320.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3225 - RNA, 2284 nt, Artificial Sequence
  KY328290.1 prME-short mRNA Design 1 wild type
gggagaaagcuuaccaugacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3226 - RNA, 2284 nt, Artificial Sequence
  KU681081.3 prME-short mRNA Design 1 wild type
gggagaaagcuuaccaugacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3227 - RNA, 2284 nt, Artificial Sequence
  KX827309.1 prME-short mRNA Design 1 wild type
gggagaaagcuuaccaugacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3228 - RNA, 2284 nt, Artificial Sequence
  KU955593.1 prME-short mRNA Design 1 wild type
gggagaaagcuuaccaugacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3229 - RNA, 2284 nt, Artificial Sequence
  KY272987.1 prME-short mRNA Design 1 wild type
gggagaaagcuuaccaugacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3230 - RNA, 2284 nt, Artificial Sequence
  KY007221.1 prME-short mRNA Design 1 wild type
gggagaaagcuuaccaugacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3231 - RNA, 2284 nt, Artificial Sequence
  EU545988.1 prME-short mRNA Design 1 wild type
gggagaaagcuuaccaugacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3232 - RNA, 2284 nt, Artificial Sequence
  KU681082.3 prME-short mRNA Design 1 wild type
gggagaaagcuuaccaugacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3233 - RNA, 2284 nt, Artificial Sequence
  KX601167.1 prME-short mRNA Design 1 wild type
gggagaaagcuuaccaugaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3234 - RNA, 2284 nt, Artificial Sequence
  KX694533.2 prME-short mRNA Design 1 wild type
gggagaaagcuuaccaugaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3235 - RNA, 2284 nt, Artificial Sequence
  KY288905.1 prME-short mRNA Design 1 wild type
gggagaaagcuuaccaugaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3236 - RNA, 2284 nt, Artificial Sequence
  KF268950.1 prME-short mRNA Design 1 wild type
gggagaaagcuuaccaugaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3237 - RNA, 2284 nt, Artificial Sequence
  KF383121.1 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3238 - RNA, 2266 nt, Artificial Sequence
  KF268949.1 prME-short mRNA Design 1 wild type
gggagaaagcuuaccaugaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3239 - RNA, 2284 nt, Artificial Sequence
  KU955595.1 prME-short mRNA Design 1 wild type
gggagaaagcuuaccaugaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3240 - RNA, 2284 nt, Artificial Sequence
  KF383116.1 prME-short mRNA Design 1 wild type
gggagaaagcuuaccaugaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3241 - RNA, 2266 nt, Artificial Sequence
  KX601166.1 prME-short mRNA Design 1 wild type
gggagaaagcuuaccaugaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3242 - RNA, 2284 nt, Artificial Sequence
  KF383118.1 prME-short mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3243 - RNA, 2281 nt, Artificial Sequence
  KX447520.1 prME-short mRNA Design 1 wild type
gggagaaagcuuaccaugagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3244 - RNA, 2284 nt, Artificial Sequence
  KU761561.1 prME-short mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3245 - RNA, 2284 nt, Artificial Sequence
  KX806557.2 prME-short mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3246 - RNA, 2284 nt, Artificial Sequence
  LC191864.1 prME-short mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3247 - RNA, 2284 nt, Artificial Sequence
  KU744693.1 prME-short mRNA Design 1 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucagguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3248 - RNA, 2275 nt, Artificial Sequence
  KU963574.2 prME-short mRNA Design 1 wild type
gggagaaagcuuaccaugggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3249 - RNA, 2293 nt, Artificial Sequence
  KF383120.1 prME-short mRNA Design 1 wild type
gggagaaagcuuaccaugggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3250 - RNA, 1576 nt, Artificial Sequence; identical to SEQ ID NO: 236
  KU321639.1 solE mRNA Design 1 wild type

SEQ ID NO: 3251 - RNA, 1576 nt, Artificial Sequence; identical to SEQ ID NO: 240
  KU312312.1 solE mRNA Design 1 wild type

SEQ ID NO: 3252 - RNA, 1564 nt, Artificial Sequence; identical to SEQ ID NO: 244
  AY632535.2 solE mRNA Design 1 wild type

SEQ ID NO: 3253 - RNA, 1576 nt, Artificial Sequence; identical to SEQ ID NO: 3028
  KU527068.1 solE mRNA Design 1 wild type

SEQ ID NO: 3254 - RNA, 1576 nt, Artificial Sequence
  KX421193.1 solE mRNA Design 1 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3255 - RNA, 1576 nt, Artificial Sequence
  LC002520.1 solE mRNA Design 1 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3256 - RNA, 1558 nt, Artificial Sequence
  DQ859059.1 solE mRNA Design 1 wild type
gggagaaagcuuaccaugagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3257 - RNA, 1564 nt, Artificial Sequence
  KU963573.2 solE mRNA Design 1 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3258 - RNA, 1576 nt, Artificial Sequence
  KY075939.1 solE mRNA Design 1 wild type
gggagaaagcuuaccaugagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3259 - RNA, 1576 nt, Artificial Sequence
  KX447516.1 solE mRNA Design 1 wild type
gggagaaagcuuaccaugagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3260 - RNA, 1576 nt, Artificial Sequence
  KX447515.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3261 - RNA, 1576 nt, Artificial Sequence
  KU758874.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3262 - RNA, 1576 nt, Artificial Sequence
  KU729218.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3263 - RNA, 1576 nt, Artificial Sequence
  KU501217.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3264 - RNA, 1576 nt, Artificial Sequence
  KU761561.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3265 - RNA, 1576 nt, Artificial Sequence
  KY075937.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3266 - RNA, 1576 nt, Artificial Sequence
  KY014317.1 solE mRNA Design 1 wild type
gggagaaagcuuaccaugagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3267 - RNA, 1576 nt, Artificial Sequence
  KU870645.1 solE mRNA Design 1 wild type
gggagaaagcuuaccaugagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3268 - RNA, 1576 nt, Artificial Sequence
  KU922923.1 solE mRNA Design 1 wild type
gggagaaagcuuaccaugagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3269 - RNA, 1576 nt, Artificial Sequence
  KU497555.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3270 - RNA, 1576 nt, Artificial Sequence
  KU312314.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3271 - RNA, 1576 nt, Artificial Sequence
  KY014314.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3272 - RNA, 1576 nt, Artificial Sequence
  KX447517.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3273 - RNA, 1576 nt, Artificial Sequence
  KU729217.2 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3274 - RNA, 1576 nt, Artificial Sequence
  KY328290.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3275 - RNA, 1576 nt, Artificial Sequence
  KX087101.3 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3276 - RNA, 1576 nt, Artificial Sequence
  KY003156.1 solE mRNA Design 1 wild type
gggagaaagcuuaccaugagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3277 - RNA, 1576 nt, Artificial Sequence
  KU758876.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3278 - RNA, 1576 nt, Artificial Sequence
  KU926310.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3279 - RNA, 1576 nt, Artificial Sequence
  KU681081.3 solE mRNA Design 1 wild type
gggagaaagcuuaccaugagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3280 - RNA, 1576 nt, Artificial Sequence
  KU744693.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3281 - RNA, 1576 nt, Artificial Sequence
  EU545988.1 solE mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3282 - RNA, 1576 nt, Artificial Sequence
  KY007221.1 solE mRNA Design 1 wild type
gggagaaagcuuaccaugagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3283 - RNA, 1576 nt, Artificial Sequence
  KY003152.1 solE mRNA Design 1 wild type
gggagaaagcuuaccaugagccaaaaagucauauauuuggucaugauacugcugauugccccggcauacagcaucaggugcauaggagucagcaauagggacuuuguggaagguaugucaggugggacuuggguugauguugucuuggaacauggaggcuguguuaccguaauggcacaggacaaaccgacugucgacauagagcugguuacaacaacaguuagcaacauggcggagguaagauccuacugcuaugaggcaucaauaucggauauggcuucggacagccgcugcccaacacaaggugaggccuaccuugacaagcagucagacacucaauaugucugcaaaagaacguuaguggauagaggcuggggaaauggauguggacuuuuuggaaaagggagccuggugacaugcgcuaaguuugcaugcuccaagaaaaugaccgggaagagcauccagccagagaaccuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggugugucauacuccuugugugcugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3284 - RNA, 1576 nt, Artificial Sequence
  KX694533.2 solE mRNA Design 1 wild type
gggagaaagcuuaccaugagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3285 - RNA, 1576 nt, Artificial Sequence
  KX601167.1 solE mRNA Design 1 wild type
gggagaaagcuuaccaugagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3286 - RNA, 1576 nt, Artificial Sequence
  KY288905.1 solE mRNA Design 1 wild type
gggagaaagcuuaccaugagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3287 - RNA, 1576 nt, Artificial Sequence
  KF268950.1 solE mRNA Design 1 wild type
gggagaaagcuuaccaugagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3288 - RNA, 1576 nt, Artificial Sequence
  KF383116.1 solE mRNA Design 1 wild type
gggagaaagcuuaccaugagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3289 - RNA, 1558 nt, Artificial Sequence
  KU963574.2 solE mRNA Design 1 wild type
gggagaaagcuuaccaugagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3290 - RNA, 1576 nt, Artificial Sequence
  KF383118.1 solE mRNA Design 1 wild type
gggagaaagcuuaccaugagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3291 - RNA, 1576 nt, Artificial Sequence
  KX520666.1 solE mRNA Design 1 wild type
gggagaaagcuuaccaugcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3292 - RNA, 1576 nt, Artificial Sequence
  KF383120.1 solE mRNA Design 1 wild type
gggagaaagcuuaccaugagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3293 - RNA, 2359 nt, Artificial Sequence; identical to SEQ ID NO: 247
  R4804/R4834 ZIKV (strain ZikaSPH2015) Polyprotein(93-804) mRNA Design 1 GC

SEQ ID NO: 3294 - RNA, 2359 nt, Artificial Sequence; identical to SEQ ID NO: 252
  R4816/R4838 ZIKV (isolate Z1106033) Polyprotein(93-804) mRNA Design 1 GC

SEQ ID NO: 3295 - RNA, 2347 nt, Artificial Sequence; identical to SEQ ID NO: 257
  R4820/R4842 ZIKV (strain MR 766) Polyprotein(93-800) mRNA Design 1 GC

SEQ ID NO: 3296 - RNA, 2359 nt, Artificial Sequence
  R4868/R5082 ZIKV (strain NatalRGN) Polyprotein(93-804) mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3297 - RNA, 2284 nt, Artificial Sequence
  R4880/R5081 ZIKV (strain ZikaSPH2015) Polyprotein(108-794) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3298 - RNA, 2284 nt, Artificial Sequence
  ZIKV (isolate Z1106033) Polyprotein(108-794) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3299 - RNA, 2272 nt, Artificial Sequence
  ZIKV (strain MR 766) Polyprotein(108-790) mRNA Design 1 GC
gggagaaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3300 - RNA, 2284 nt, Artificial Sequence
  R4870/R5083 ZIKV (strain NatalRGN) Polyprotein(108-794) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3301 - RNA, 1576 nt, Artificial Sequence; identical to SEQ ID NO: 249
  R4826/R4846 ZIKV (strain ZikaSPH2015) Polyprotein(273-723) mRNA Design 1 GC

SEQ ID NO: 3302 - RNA, 1576 nt, Artificial Sequence; identical to SEQ ID NO: 254
  R4825/R4845 ZIKV (isolate Z1106033) Polyprotein(273-723) mRNA Design 1 GC

SEQ ID NO: 3303 - RNA, 1564 nt, Artificial Sequence; identical to SEQ ID NO: 259
  ZIKV (strain MR 766) Polyprotein(273-719) mRNA Design 1 GC

SEQ ID NO: 3304 - RNA, 1576 nt, Artificial Sequence
  ZIKV (strain NatalRGN) Polyprotein(273-723) mRNA Design 1 GC
gggagaaagcuuaccaugagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3305 - RNA, 2284 nt, Artificial Sequence
  ZIKV (strain ZikaSPH2015) Polyprotein(108-794)(F398S) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuccgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3306 - RNA, 2284 nt, Artificial Sequence
  ZIKV (isolate Z1106033) Polyprotein(108-794)(F398S) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3307 - RNA, 2272 nt, Artificial Sequence
  ZIKV (strain MR 766) Polyprotein(108-790)(F398S) mRNA Design 1 GC
gggagaaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguccggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3308 - RNA, 2284 nt, Artificial Sequence
  ZIKV (strain NatalRGN) Polyprotein(108-794)(F398S) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3309 - RNA, 2284 nt, Artificial Sequence
  ZIKV (strain ZikaSPH2015) Polyprotein(108-794)(N444Q) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucguccaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3310 - RNA, 2284 nt, Artificial Sequence
  ZIKV (isolate Z1106033) Polyprotein(108-794)(N444Q) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3311 - RNA, 2284 nt, Artificial Sequence
  ZIKV (strain NatalRGN) Polyprotein(108-794)(N444Q) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3312 - RNA, 2284 nt, Artificial Sequence
  ZIKV (strain ZikaSPH2015) Polyprotein(108-694)-Cterm-JAEV1-E(400-500) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3313 - RNA, 2284 nt, Artificial Sequence
  ZIKV (isolate Z1106033) Polyprotein(108-694)-Cterm-JAEV1-E(400-500) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3314 - RNA, 2272 nt, Artificial Sequence
  ZIKV (strain MR 766) Polyprotein(108-690)-Cterm-JAEV1-E(400-500) mRNA Design 1 GC
gggagaaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3315 - RNA, 2284 nt, Artificial Sequence
  ZIKV (strain NatalRGN) Polyprotein(108-694)-Cterm-JAEV1-E(400-500) mRNA Design 1 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3316 - RNA, 2359 nt, Artificial Sequence
  R5620 ZIKV (strain ZikaSPH2015) Polyprotein(93-804) mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3317 - RNA, 2356 nt, Artificial Sequence
  ZIKV prME variant mRNA Design 1 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3318 - RNA, 2353 nt, Artificial Sequence
  ZIKV prME variant mRNA Design 1 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3319 - RNA, 2350 nt, Artificial Sequence
  ZIKV prME variant mRNA Design 1 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3320 - RNA, 2347 nt, Artificial Sequence
  ZIKV prME variant mRNA Design 1 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3321 - RNA, 2344 nt, Artificial Sequence
  ZIKV prME variant mRNA Design 1 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3322 - RNA, 2341 nt, Artificial Sequence
  ZIKV prME variant mRNA Design 1 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3323 - RNA, 2338 nt, Artificial Sequence
  ZIKV prME variant mRNA Design 1 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3324 - RNA, 2335 nt, Artificial Sequence
  ZIKV prME variant mRNA Design 1 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3325 - RNA, 2332 nt, Artificial Sequence
  ZIKV prME variant mRNA Design 1 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3326 - RNA, 2329 nt, Artificial Sequence
  ZIKV prME variant mRNA Design 1 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3327 - RNA, 2326 nt, Artificial Sequence
  ZIKV prME variant mRNA Design 1 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3328 - RNA, 2323 nt, Artificial Sequence
  ZIKV prME variant mRNA Design 1 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3329 - RNA, 2320 nt, Artificial Sequence
  ZIKV prME variant mRNA Design 1 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3330 - RNA, 2317 nt, Artificial Sequence
  ZIKV prME variant mRNA Design 1 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3331 - RNA, 2314 nt, Artificial Sequence
  ZIKV prME variant mRNA Design 1 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3332 - RNA, 2314 nt, Artificial Sequence
  ZIKV prME variant mRNA Design 1 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3333 - RNA, 2326 nt, Artificial Sequence
  ZIKV prME variant mRNA Design 1 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3334 - RNA, 2350 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3335 - RNA, 2350 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3336 - RNA, 2341 nt, Artificial Sequence
  ZIKV prME variant mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3337 - RNA, 2338 nt, Artificial Sequence
  ZIKV prME variant mRNA Design 1 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3338 - RNA, 2335 nt, Artificial Sequence
  ZIKV prME variant mRNA Design 1 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3339 - RNA, 2332 nt, Artificial Sequence
  ZIKV prME variant mRNA Design 1 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3340 - RNA, 2329 nt, Artificial Sequence
  ZIKV prME variant mRNA Design 1 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3341 - RNA, 2326 nt, Artificial Sequence
  ZIKV prME variant mRNA Design 1 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3342 - RNA, 2323 nt, Artificial Sequence
  ZIKV prME variant mRNA Design 1 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3343 - RNA, 2320 nt, Artificial Sequence
  ZIKV prME variant mRNA Design 1 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3344 - RNA, 2317 nt, Artificial Sequence
  ZIKV prME variant mRNA Design 1 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3345 - RNA, 2314 nt, Artificial Sequence
  ZIKV prME variant mRNA Design 1 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3346 - RNA, 2311 nt, Artificial Sequence
  ZIKV prME variant mRNA Design 1 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3347 - RNA, 2308 nt, Artificial Sequence
  ZIKV prME variant mRNA Design 1 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3348 - RNA, 2305 nt, Artificial Sequence
  ZIKV prME variant mRNA Design 1 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3349 - RNA, 2302 nt, Artificial Sequence
  ZIKV prME variant mRNA Design 1 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3350 - RNA, 2299 nt, Artificial Sequence
  ZIKV prME variant mRNA Design 1 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3351 - RNA, 2296 nt, Artificial Sequence
  ZIKV prME variant mRNA Design 1 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3352 - RNA, 2296 nt, Artificial Sequence
  ZIKV prME variant mRNA Design 1 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3353 - RNA, 2308 nt, Artificial Sequence
  ZIKV prME variant mRNA Design 1 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3354 - RNA, 2332 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3355 - RNA, 2332 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3356 - RNA, 2332 nt, Artificial Sequence
  ZIKV prME variant mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3357 - RNA, 2329 nt, Artificial Sequence
  ZIKV prME variant mRNA Design 1 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3358 - RNA, 2326 nt, Artificial Sequence
  ZIKV prME variant mRNA Design 1 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3359 - RNA, 2323 nt, Artificial Sequence
  ZIKV prME variant mRNA Design 1 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3360 - RNA, 2320 nt, Artificial Sequence
  ZIKV prME variant mRNA Design 1 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3361 - RNA, 2317 nt, Artificial Sequence
  ZIKV prME variant mRNA Design 1 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3362 - RNA, 2314 nt, Artificial Sequence
  ZIKV prME variant mRNA Design 1 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3363 - RNA, 2311 nt, Artificial Sequence
  ZIKV prME variant mRNA Design 1 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3364 - RNA, 2308 nt, Artificial Sequence
  ZIKV prME variant mRNA Design 1 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3365 - RNA, 2305 nt, Artificial Sequence
  ZIKV prME variant mRNA Design 1 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3366 - RNA, 2302 nt, Artificial Sequence
  ZIKV prME variant mRNA Design 1 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3367 - RNA, 2299 nt, Artificial Sequence
  ZIKV prME variant mRNA Design 1 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3368 - RNA, 2296 nt, Artificial Sequence
  ZIKV prME variant mRNA Design 1 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3369 - RNA, 2293 nt, Artificial Sequence
  ZIKV prME variant mRNA Design 1 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3370 - RNA, 2290 nt, Artificial Sequence
  ZIKV prME variant mRNA Design 1 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3371 - RNA, 2287 nt, Artificial Sequence
  ZIKV prME variant mRNA Design 1 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3372 - RNA, 2287 nt, Artificial Sequence
  ZIKV prME variant mRNA Design 1 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3373 - RNA, 2299 nt, Artificial Sequence
  ZIKV prME variant mRNA Design 1 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3374 - RNA, 2323 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3375 - RNA, 2323 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3376 - RNA, 2329 nt, Artificial Sequence
  ZIKV prME variant mRNA Design 1 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3377 - RNA, 2323 nt, Artificial Sequence
  ZIKV prME variant mRNA Design 1 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3378 - RNA, 2326 nt, Artificial Sequence
  ZIKV prME variant mRNA Design 1 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3379 - RNA, 2320 nt, Artificial Sequence
  ZIKV prME variant mRNA Design 1 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3380 - RNA, 2317 nt, Artificial Sequence
  ZIKV prME variant mRNA Design 1 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3381 - RNA, 2314 nt, Artificial Sequence
  ZIKV prME variant mRNA Design 1 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3382 - RNA, 2311 nt, Artificial Sequence
  ZIKV prME variant mRNA Design 1 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3383 - RNA, 2308 nt, Artificial Sequence
  ZIKV prME variant mRNA Design 1 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3384 - RNA, 2305 nt, Artificial Sequence
  ZIKV prME variant mRNA Design 1 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3385 - RNA, 2302 nt, Artificial Sequence
  ZIKV prME variant mRNA Design 1 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3386 - RNA, 2299 nt, Artificial Sequence
  ZIKV prME variant mRNA Design 1 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3387 - RNA, 2296 nt, Artificial Sequence
  ZIKV prME variant mRNA Design 1 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3388 - RNA, 2293 nt, Artificial Sequence
  ZIKV prME variant mRNA Design 1 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3389 - RNA, 2290 nt, Artificial Sequence
  ZIKV prME variant mRNA Design 1 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3390 - RNA, 2287 nt, Artificial Sequence
  ZIKV prME variant mRNA Design 1 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3391 - RNA, 2284 nt, Artificial Sequence
  R5616 ZIKV (strain ZikaSPH2015) Polyprotein(108-794) mRNA Design 1 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3392 - RNA, 2284 nt, Artificial Sequence
  ZIKV prME variant mRNA Design 1 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3393 - RNA, 2296 nt, Artificial Sequence
  ZIKV prME variant mRNA Design 1 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3394 - RNA, 2320 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3395 - RNA, 2320 nt, Artificial Sequence
  ZIKV prME variant mRNA Design 1 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3396 - RNA, 2359 nt, Artificial Sequence; identical to SEQ ID NO: 247
  KU321639.1 prME-long mRNA Design 1 GC

SEQ ID NO: 3397 - RNA, 2359 nt, Artificial Sequence; identical to SEQ ID NO: 252
  KU312312.1 prME-long mRNA Design 1 GC

SEQ ID NO: 3398 - RNA, 2347 nt, Artificial Sequence; identical to SEQ ID NO: 257
  AY632535.2 prME-long mRNA Design 1 GC

SEQ ID NO: 3399 - RNA, 2359 nt, Artificial Sequence; identical to SEQ ID NO: 3296
  KU527068.1 prME-long mRNA Design 1 GC

SEQ ID NO: 3400 - RNA, 2359 nt, Artificial Sequence
  KU720415.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3401 - RNA, 2341 nt, Artificial Sequence
  DQ859059.1 prME-long mRNA Design 1 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacacggggaccccgcacuggaacaacaaggaggcccugguggaguucaaggacgcccacgccaagcggcagaccgucguggugcucggcagccaggagggggcgguccacaccgcccuggccggcgcccuggaggcggagauggacggggccaagggccgccucuucuccggccaccugaagugccggcugaagauggacaagcuccgccugaagggggugagcuacucccugugcacggccgccuucaccuucaccaaggugcccgccgagacccuccacggcaccgucacgguggaggugcaguacgcggggaccgacggccccugcaagguccccgcccagauggccguggacaugcagacccugaccccggugggccggcugaucacggccaaccccgucaucaccgagagcaccgagaacuccaagaugaugcucgagcuggacccgcccuucggggacagcuacaucgugaucggcgugggggacaagaagaucacccaccacuggcaccgcuccggcagcacgaucgggaaggccuucgaggcgaccguccggggcgccaagcgcauggccgugcugggcgacaccgccugggacuucgggagcgugggcggggucuucaacucccucggcaaggggauccaccagaucuucggcgccgcguucaagagccuguucggcgggauguccugguucagccagauccugaucggcacccugcucguguggcuggggcugaacacgaagaacggcuccaucagccugaccugccuggcccucgggggcgugaugaucuuccucuccaccgccgucagcgccgacgugggcugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3402 - RNA, 2359 nt, Artificial Sequence
  KX377335.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccgcaagaagggcgaggcccggcgcagccggcgcgcggugacccuccccucccacagcacccggaagcugcagacccgcucccagacguggcuggagagccgggaguacaccaagcaccucaucaaggucgagaacuggaucuuccgcaaccccggguucgcccugguggccguggccaucgccuggcugcucggcuccagcaccucccagaaggucaucuaccuggugaugauccugcucaucgcgcccgccuacagcauccggugcaucgggguguccaaccgcgacuucgucgagggcaugagcggcgggaccuggguggacgugguccuggagcacggcgggugcgugacggugauggcccaggacaagccgaccgucgacaucgagcuggugaccaccacgguguccaacauggccgagguccggagcuacugcuacgaggccuccaucagcgacauggcgagcgacucccgcugccccacccagggcgaggccuaccucgacaagcagagcgacacccaguacgugugcaagcggacccugguggaccgcggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgggccaagguggaggugacccccaacuccccgcgcgccgaggcgacccucgggggcuucgggagccugggccuggacugcgagccccggaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcgccagaccguggucgugcucgggagccaggagggcgccgugcacacggcccuggccggggcgcuggaggccgagauggacggcgccaagggcaagcuguucuccgggcaccucaagugccggcugaagauggacaagcuccgccugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcggcugaucaccgccaaccccgugaucaccgagagcaccgagaacuccaagaugaugcucgagcuggacccgcccuucggcgacagcuacaucgucaucggggugggcgacaagaagaucacgcaccacuggcaccgcuccgggagcaccaucggcaaggccuucgaggcgaccgugcggggcgccaagcgcauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3403 - RNA, 2359 nt, Artificial Sequence
  LC002520.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaccgucaacgacaucggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3404 - RNA, 2347 nt, Artificial Sequence
  KU963573.2 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucggcuacgagaccgacgagaaccgcgccaaggucgaggugacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggcaagcuguucuccgggcaccucaagugccgccugaagauggacaagcuccggcugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcgccugaucacggccaaccccgugaucaccgagagcaccgagaacuccaagaugaugcucgagcuggacccgcccuucggcgacagcuacaucgugaucggggucggcgacaagaagaucacccaccacuggcaccgguccgggagcacgaucggcaaggccuucgaggcgaccgugcgcggcgccaagcggauggccgugcugggggacaccgccugggacuucggcagcgucgggggcguguucaacucccucgggaagggcauccaccagaucuucggcgccgcguucaagagccuguucgggggcauguccugguucagccagauccugaucgggacccugcucguguggcugggccugaacacgaagaacggguccaucagccugaccugccucgcccugggcggcgucaugaucuuccucuccaccgccgugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3405 - RNA, 2359 nt, Artificial Sequence
  KX694534.2 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggcggggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3406 - RNA, 2359 nt, Artificial Sequence
  KX447520.1 prME-long mRNA Design 1 GC
gggagaaagcuuaccaugcgcaucaucaacgcccggaaggagaagaagcgccggggcgccgacgcgagcguggggaucgucggccugcuccugaccaccgccauggccgccgaggugacgcgccggggguccgccuacuacauguaccuggaccgcaacgacgcgggcgaggccaucagcuuccccaccacccucgggaugaacaagugcuacauccagaucauggaccugggccacaugugcgacgccaccauguccuacgagugcccgaugcuggacgagggcguggagcccgacgacgucgacugcuggugcaacacgaccagcaccugggugguguacgggaccugccaccacaagaagggcgaggcccggcgcucccggcgcgcggucacgcuccccagccacuccacccggaagcugcagacccgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3407 - RNA, 2359 nt, Artificial Sequence
  KX369547.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccgggcuggcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3408 - RNA, 2359 nt, Artificial Sequence
  KX447515.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacugguaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3409 - RNA, 2359 nt, Artificial Sequence
  KU501217.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgagauccgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3410 - RNA, 2359 nt, Artificial Sequence
  KU312314.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugcuggcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3411 - RNA, 2359 nt, Artificial Sequence
  KX446950.2 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgacccuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgcccuucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3412 - RNA, 2359 nt, Artificial Sequence
  KY003157.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccguggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3413 - RNA, 2359 nt, Artificial Sequence
  KX811222.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcgccugggugguguacgggaccugccaccacaagaagggcgaggcccggcgcucccggcgcgcggucacgcuccccagccacuccacccggaagcugcagacccgcccccagaccuggcuggagagccgggaguacacgaagcaccucauccgcguggagaacuggaucuuccggaacccgggguucgcccuggccgccgccgcgaucgccuggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggcggaggugcgcagcuacugcuacgaggccuccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgcgugcagcaagaagaugacgggcaaguccauccagccggagaaccuggaguaccgcaucaugcugagcguccacggcucccagcacagcgggaugaucgugaacgacaccggccacgagaccgacgagaaccgcgccaaggucgagaucacccccaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccgcugcccuggcacgccggggcggacaccggcacgccccacuggaacaacaaggaggcccugguggaguucaaggacgcccacgccaagcggcagaccgucguggugcucgggagccaggagggcgcgguccacaccgcccuggccggggcccuggaggccgagauggacggcgcgaagggccgccucuccagcgggcaccugaagugccggcugaagauggacaagcuccgccugaagggcguguccuacagccugugcaccgccgccuucacguucaccaagauccccgccgagacccuccacgggaccgugaccgucgaggugcaguacgccggcacggacggcccgugcaaggugcccgcgcagauggccgucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgcgaagcgcauggccguccugggggacaccgccugggacuucggcagcgucgggggcgcccucaacagccuggggaagggcauccaccagaucuucggcgcggccuucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3414 - RNA, 2359 nt, Artificial Sequence
  KX447516.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagcaagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3415 - RNA, 2359 nt, Artificial Sequence
  KX520666.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccacccgccagaaggugaucuaccuggucaugauccugcucaucgccccggccuacagcauccggugcaucgggguguccaaccgcgacuucguggagggcaugagcggcgggaccugggucgacguggugcuggagcacggcgggugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgggcgaaggucgagaucacgccgaacagcccccgcgccgaggccacccucgggggcuucgggucccugggccuggacugcgagccccggaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggagccaggagggcgccguccacaccgcgcuggccggggcccuggaggccgagauggacggcgccaagggccggcucuccagcgggcaccugaagugccgccugaagauggacaagcuccggcugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgaguccaccgagaacagcaagaugaugcucgagcuggacccgcccuucggcgacuccuacaucgucaucggggugggcgagaagaagaucacccaccacuggcaccggagcggguccacgaucggcaaggccuucgaggccaccgugcgcggcgccaagcggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3416 - RNA, 2359 nt, Artificial Sequence
  KU729218.1 prME-long mRNA Design 1 GC
gggagaaagcuuaccaugcgcaucaucaacgcccggaaggagaagaagcgccggagcgccgacaccuccgugggcaucgucgggcugcuccugaccacggcgauggccgccgaggugacccgccggggcagcgccuacuacauguaccuggaccgcaacgacgccggggaggcgaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucauccgcguggagaacuggaucuuccggaaccccggcuucgcgcuggccgccgccgccaucgcguggcugcucggguccagcaccucccagaaggugaucuaccuggucaugauccugcucaucgccccggccuacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggcguccaucagcgacauggccagcgacucccggugccccacccagggggaggccuaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgcgcgaaggucgagaucacgccgaacagcccccgggccgaggccacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcggcagaccgucguggugcucggcagccaggagggggccguccacaccgcgcuggccggcgcccuggaggccgagauggacggggccaagggccgccucuccagcggccaccugaagugccggcugaagauggacaagcuccgccugaaggggguguccuacagccugugcaccgcggccuucaccuucaccaagauccccgccgagacccuccacggcaccgugacggucgaggugcaguacgccgggaccgacggccccugcaaggugccggcccagauggcggucgacacccagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcagcaccaucgggaaggccuucgaggccaccgugcggggcgccaagcgcauggcgguccugggcgacaccgccugggacuucggguccgugggcggggcccucaacagccugggcaaggggauccaccagaucuucggcgccgcguucaagucccuguucggcgggaugagcugguucucccagauccugaucggcacgcuccugauguggcuggggcucaacaccaagaacggcagcaucucccugaugugccuggcccucgggggcgugcugaucuuccugagcaccgccgucuccgccgacgugggcugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3417 - RNA, 2359 nt, Artificial Sequence
  KU761561.1 prME-long mRNA Design 1 GC
gggagaaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgcccgccggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3418 - RNA, 2359 nt, Artificial Sequence
  KY317938.1 prME-long mRNA Design 1 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3419 - RNA, 2359 nt, Artificial Sequence
  KY075939.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacucccugcgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3420 - RNA, 2359 nt, Artificial Sequence
  KX806557.2 prME-long mRNA Design 1 GC
gggagaaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggauguuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3421 - RNA, 2359 nt, Artificial Sequence
  KU870645.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggauccugcggaaccccggguucgcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucgggaucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3422 - RNA, 2359 nt, Artificial Sequence
  KU729217.2 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucagcaccaccguguccaacauggccgaggugcgcagcuacugcuacgaggcgacgaucuccgacaucgccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgccgucgugcucgggucccaggagggcgcggugcacaccgcccuggccggggcccuggaggccgagauggacggcgcgaagggccgccucagcuccgggcaccugaagugccggcugaagauggacaagcuccgccugaagggcgucagcuacucccugugcaccgccgccuucaccuucaccaagauccccgccgagacccuccacgggaccgugacgguggagguccaguacgccggcaccgacggccccugcaaggugccggcgcagauggccguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgcgaagcgcauggccgugcugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3423 - RNA, 2359 nt, Artificial Sequence
  KU497555.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggacccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgaguccaccgagaacagcaagaugaugcucgagcuggacccgcccuucggcgacuccuacaucgucaucggggugggcgagaagaagaucacgcaccacuggcaccgcagcggguccaccaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacgcuccugauguggcugggccucaacaccaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3424 - RNA, 2359 nt, Artificial Sequence
  KX087101.3 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgagcugcaguacgccggcaccgacggccccugcaaggugccggcccagauggcgguggacaugcagacccugacccccgucgggcggcucaucacggccaaccccgugaucaccgagagcaccgagaacuccaagaugaugcuggagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3425 - RNA, 2359 nt, Artificial Sequence
  KY075932.1 prME-long mRNA Design 1 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcaucgagaacuggaucuuccggaaccccggguucgcgcuggccgccgccgccaucgcguggcugcucggcagcuccaccagccagaaggugaucuaccuggugaugauccugcucaucgccccggccuacuccauccgcugcaucggggucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3426 - RNA, 2359 nt, Artificial Sequence
  KY014317.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaucgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3427 - RNA, 2359 nt, Artificial Sequence
  KU758876.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgugaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagcuucaugugccuggcgcugggcggcgugcucaucuuccuguccaccgccgugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3428 - RNA, 2359 nt, Artificial Sequence
  KU758874.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggcaagcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3429 - RNA, 2359 nt, Artificial Sequence
  KY014314.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggaggcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3430 - RNA, 2359 nt, Artificial Sequence
  KU926310.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcgccgacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3431 - RNA, 2359 nt, Artificial Sequence
  KU761560.1 prME-long mRNA Design 1 GC
gggagaaagcuuaccaugcgcaucaucaacgccggcaaggagaagaagcggcgcggggccgacaccaacgugggcaucgucgggcugcuccugaccacggcgauggccgccgaggugacccggcgcggcagcgccuacuacauguaccuggaccggaacgacgccggggaggcgaucuccuuccccaccacccucggcaugaacaagugcuacauccagaucauggaccugggccacaugugcgacgccacgaugagcuacgagugcccgaugcuggacgaggggguggagcccgacgacgucgacugcuggugcaacaccaccuccaccugggugguguacggcacgugccaccacaagaagggggaggcccgccggagccgccgggccgucacccuccccucccacagcacccgcaagcugcagacccggucccagacguggcuggagagccgcgaguacaccaagcaccucauccggguggagaacuggaucuuccgcaaccccggcuucgcgcuggccgccgccgccaucgcguggcugcucggguccagcaccucccagaaggugaucuaccuggucaugauccugcucaucgccccggccuacagcauccggugcaucggcguguccaaccgcgacuucguggagggcaugagcgggggcaccugggucgacguggugcuggagcacgggggcugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggguggggcaacgggugcggccuguucgggaagggcucccucgugacgugcgccaaguucgccugcagcaagaagaugaccggcaaguccauccagcccgagaaccuggaguaccggaucaugcugagcguccacgggucccagcacagcggcaugaucgugaacgacaccgggcacgagaccgacgagaaccgcgcgaaggucgagaucacgccgaacagcccccgcgccgaggccacccucggcggguucggcucccugggccuggacugcgagccccggaccgggcucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcgccagaccgucguggugcucggcagccaggagggggccguccacaccgcgcuggccggcgcccuggaggccgagauggacggcgccaaggggcggcucuccagcggccaccugaagugccgccugaagauggacaagcuccggcugaaggggguguccuacagccugugcaccgcggccuucaccuucaccaagauccccgccgagacccuccacggcaccgugacggucgaggugcaguacgccggcaccgacgggcccugcaaggugccggcccagauggcggucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucggcaaggccuucgaggccaccgugcgcggggcccggcgcauggcgguccugggcgacaccgccugggacuucgggagcgugggcggggcccucaacagccugggcaagggcauccaccagaucuucggggccgcguucaagucccuguucggcgggaugagcugguucucccagauccugaucggcacccuccugauguggcuggggcucaacacgaagaacggcagcaucucccugaugugccuggcccucggcggggugcugaucuuccugagcaccgccgucuccgccgacgugggcugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3432 - RNA, 2359 nt, Artificial Sequence
  KY317939.1 prME-long mRNA Design 1 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaaggacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3433 - RNA, 2359 nt, Artificial Sequence
  KY075937.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggucagcgacagccggugccccacccagggcgaggccuaccucgacaagcaguccgacacccaguacgugugcaagcgcacccugguggaccggggcugggggaacggcugcgggcuguucggcaaggggagccucgucacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggucccaggagggcgccgugcacaccgcccuggcgggggcccuggaggccgagauggacggcgccaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3434 - RNA, 2359 nt, Artificial Sequence
  LC191864.1 prME-long mRNA Design 1 GC
gggagaaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaugaccuccaccugggugguguacgggaccugccaccacaagaagggcgaggcccggcgcagccggcgcgccgucacgcuccccucccacagcacccggaagcugcagacccgcucccagaccuggcuggagagccgggaguacacgaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggccgaggugcgcagcuacugcuacgaggcguccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgccugcagcaagaagaugacgggcaaguccauccagcccgagaaccuggaguaccgcaucaugcugagcguccacggcucccagcacagcgggaugaucgugaacgacaccggccacgagaccgacgagaaccgcgcgaaggucgagaucaccccgaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucacguucaccaagauccccgccgagacccuccacgggaccgugaccgucgaggugcaguacgccggcacggacggccccugcaaggugccggcccagauggcggucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3435 - RNA, 2359 nt, Artificial Sequence
  KX447517.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccgcccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagacccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3436 - RNA, 2359 nt, Artificial Sequence
  KU922923.1 prME-long mRNA Design 1 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgcccuggccuacuccauccgcugcaucggggugagcaaccgggacuucguggagggcauguccggcgggaccugggucgacguggugcuggagcacggcgggugcgucacggugauggcccaggacaagccgaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgcccaacagcccgcgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugcccuggcacgccggggccgacacgggcaccccgcacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcacggcggccuucaccuucaccaagauccccgccgagacccugcacgggaccgugacggucgaggugcaguacgccggcaccgacggccccugcaaggugcccgcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3437 - RNA, 2359 nt, Artificial Sequence
  KY003156.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucgggaucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggauccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggagccaggagggcgccgugcacaccgcgcuggccggggcccuggaggccgagauggacggcgccaagggccgccucuccagcgggcaccugaagugccggcugaagauggacaagcuccgccugaagggcgucuccuacagccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcggguccacgaucggcaaggccuucgaggccaccgugcggggcgccaagcgcauggcggugcugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacgucgggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3438 - RNA, 2359 nt, Artificial Sequence
  KU312313.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccauccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacgccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3439 - RNA, 2359 nt, Artificial Sequence
  KY075935.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccagcggucccgccgggccgucacccuccccagccacuccacccgcaagcugcagacccggagccagacguggcuggagucccgcgaguacaccaagcaccucauccggguggagaacuggaucuuccgcaaccccggguucgcgcuggccgccgccgccaucgcguggcugcucggcagcuccaccagccagaaggugaucuaccuggucaugauccugcucaucgccccggccuacuccauccggugcaucggggugagcaaccgcgacuucguggagggcauguccggcgggaccugggucgacguggugcuggagcacggcgggugcgucacggugauggcccaggacaagcccaccguggacaucgagcuggucaccaccacggugagcaacauggccgaggugcgguccuacugcuacgaggcgagcaucuccgacauggccagcgacagccgcugccccacccagggcgaggccuaccucgacaagcaguccgacacccaguacgucugcaagcggacccugguggaccgcggcugggggaacggcugcgggcuguucggcaaggggagccucgugacgugcgccaaguucgccugcuccaagaagaugaccggcaagagcauccagcccgagaaccuggaguaccggaucaugcuguccguccacggcagccagcacuccgggaugaucgugaacgacaccggccacgagaccgacgagaaccgcgcgaaggucgagaucacgccgaacagcccccgcgccgaggccacccucgggggcuucgggucccugggccuggacugcgagccccggaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggucccaggagggcgccguccacaccgcgcuggccggggcccuggaggccgagauggacggcgccaagggccggcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3440 - RNA, 2359 nt, Artificial Sequence
  KY014320.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcaggcgcgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3441 - RNA, 2359 nt, Artificial Sequence
  KX827309.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcagcgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccagcgacucccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcgggagcacgaucggcaaggccuucgaggccaccgugcggggcgccaagcgcauggcgguccugggggacaccgccugggacuucggcuccgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3442 - RNA, 2359 nt, Artificial Sequence
  KU681081.3 prME-long mRNA Design 1 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacaccggggccgacaccggcacgccccacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuccagcgggcaccugaagugccggcugaagauggacaagcuccgccugaagggcguguccuacagccugugcaccgccgccuucaccuucaccaagauccccgcggagacgcuccacgggaccgugaccgucgaggugcaguacgccggcaccgacggccccugcaaggugccggcccagauggccgucgacaugcagacgcugacccccguggggcggcugaucaccgccaaccccgugaucaccgagggcacggagaacuccaagaugaugcucgagcuggacccgcccuucggggacagcuacaucgucaucggcgugggggagaagaagaucacccaccacuggcaccgcuccggcagcaccaucggcaaggcguucgaggccaccgugcgcggggccaagcggauggccguccugggcgacacggccugggacuucgggagcgugggcggggugcucaacucccugggcaagggcauccaccagaucuucggggcggccuucaagagccuguucggcgggauguccugguucagccagauccugaucggcacccuccugauguggcuggggcucaacaccaagaacggcuccaucagccugaugugccuggcccucggcgggguccugaucuuccuguccaccgccgugagcgcggacgugggcugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3443 - RNA, 2359 nt, Artificial Sequence
  KU744693.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggccauggcccaggacaagcccaccguggacaucgagcuggugaccaccacggucagcaacauggcggaggugcgcuccuacugcuacgaggccagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgcgugcuccaagaagaugaccggcaagagcauccagcccgagaaccuggaguaccgcaucaugcuguccgugcacggcagccagcacuccgggaugcucgucaacgacaccggccacgagaccgacgagaaccgcgccaagguggagaucacgccgaacagcccccgggccgaggccacccucgggggcuucgggucccugggccuggacugcgagccccgcaccggccuggacuucagcgaccuguacuaccucaccaugaacaacaagcacuggcuggcccacaaggagugguuccacgacaucccccugccguggcacgcgggggccgccacgggcacgccccacuggaacaacaaggaggcccucgucgaguucaaggacgcgcacgccaagcggcagaccguggugguccuggggucccaggagggcgccgugcacaccgcccuggccggggcgcucgaggccgagauggacggcgccaagggccgccugagcuccgggcaccugaagugccggcucaagauggacaagcugcgccugaagggcgugagcuacucccucugcaccgccgccuucaccuucaccaagauccccgcggagaccgucgacgggaccgugacgguggagggccaguacggcgggaccgacggccccugcaaggucccggcccagauggccguggacaugcagacccugacccccguggggcggcugaucacggccaaccccgucaucaccgagagcaccgagaacuccaagaugaugcucgagcuggacccgcccuucggcgacagcuacaucgugaucggggugggcgagaagaagaucacccaccacuggcaccgcuccggcagcacgaucgggaaggccuucgaggcgaccguccggggcgccaagcgcauggccgugcugggggacaccgccugggacuucggcagcgucgggggcgcgcucaacucccugggcaaggggauccaccagaucaucggcgccgccuucaagagccuguucgggggcauguccugguucagccagauccugaucgggacccuccugauguggcugggccucaacacgaagaacggcuccaucagccugaugugccuggcccucgggggcgugcugaucuuccuguccaccgccgugagcgggggcguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3444 - RNA, 2359 nt, Artificial Sequence
  KY328290.1 prME-long mRNA Design 1 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucuccaagauccccgccgagacccuccacgggaccgugacggaggagguccaguacgccggcaccgacggccccugcaaggugccggcccagauggccguggacaugcagacccugacccccgucgggcggcugaucacggcgaaccccgugaucaccgagagcaccgagaacuccaagaugaugcucgagcuggacccgcccuucggcgacagcuacaucgugaucggggucggcgagaagaagaucacccaccacuggcaccgcagcggguccacgaucggcaaggccuucgaggccaccgugcggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3445 - RNA, 2359 nt, Artificial Sequence
  KX694532.2 prME-long mRNA Design 1 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccugaugugccuggcgcucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3446 - RNA, 2359 nt, Artificial Sequence
  KU955593.1 prME-long mRNA Design 1 GC
gggagaaagcuuaccaugcgcaucaucaacgcccggaaggagaagaagcgccggggcaccgacaccagcguggggaucgucggccugcuccugacgaccgccauggcgguggaggugacccgccgggggaacgccuacuacauguaccuggaccgcuccgacgccggcgaggccaucagcuuccccaccacgauggggaugaacaagugcuacauccagaucauggaccucggccacaugugcgacgccaccauguccuacgagugcccgaugcuggacgagggcgucgagcccgacgacguggacugcuggugcaacaccaccagcacguggguggucuacgggaccugccaccacaagaagggcgaggcgcggcgcucccggcgcgccgugacccugcccagccacuccacccggaagcuccagacgcgcagccagaccuggcuggagucccgggaguacaccaagcaccugauccgcguggagaacuggaucuuccggaaccccggguucgcccucgccgcggccgccaucgccuggcugcugggcagcuccaccagccagaaggucaucuaccucgugaugauccugcugaucgccccggcguacuccauccgcugcaucggggugagcaaccgggacuucgucgagggcauguccggcgggacguggguggacgugguccucgagcacggcgggugcgugaccgugauggcccaggacaagcccaccgucgacaucgagcuggugaccacgaccgugagcaacauggccgagguccgcuccuacugcuacgaggccagcaucuccgacauggccagcgacagccggugccccacccagggcgaggcguaccuggacaagcaguccgacacccaguacgugugcaagcgcacgcucguggaccggggcugggggaacggcugcgggcuguucggcaaggggagccuggugaccugcgccaaguucgccugcuccaagaagaugaccggcaagagcauccagcccgagaaccucgaguaccgcaucaugcuguccgugcacggcagccagcacuccgggaugaucgucaacgacaccggccacgagacggacgagaaccgcgccaagguggagaucaccccgaacagcccccgggccgaggcgacccucgggggcuucgggucccugggccuggacugcgagccccgcaccggccuggacuucagcgaccucuacuaccugacgaugaacaacaagcacuggcuggugcacaaggagugguuccacgacaucccccucccguggcacgccggggccgacaccggcacgccccacuggaacaacaaggaggcccuggucgaguucaaggacgcccacgcgaagcggcagaccguggugguccuggggucccaggagggcgccgugcacaccgcccucgccggggcgcuggaggccgagauggacggcgccaagggccgccugagcuccgggcaccucaagugccggcugaagauggacaagcugcgccucaagggcgugagcuacucccugugcaccgccgccuucaccuucaccaagauccccgcggagacccugcacgggacggucaccguggaggugcaguacgccggcaccgacggccccugcaaggucccggcccagauggccguggacaugcagacccucacgcccguggggcggcugaucaccgccaaccccgucaucaccgagagcaccgagaacuccaagaugaugcuggagcucgacccgcccuucggcgacagcuacaucgugaucggggugggcgagaagaagaucacgcaccacuggcaccgcuccgggagcaccaucggcaaggcguucgaggccaccguccggggcgccaagcgcauggccgugcugggggacaccgccugggacuucggcagcgucgggggcgcgcugaacucccucgggaagggcauccaccagaucuucggcgccgccuucaagagccuguucgggggcauguccugguucagccagauccugaucgggacgcugcucgucuggcugggccugaacaccaagaacggguccaucagccucaugugccuggcccugggcggcgugcucaucuuccuguccaccgcggugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3447 - RNA, 2359 nt, Artificial Sequence
  KY272987.1 prME-long mRNA Design 1 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccuggugugccuggcgcucggcggcgugcugaucuuccugagcaccgccguguccgccgacguggggugcagcgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3448 - RNA, 2359 nt, Artificial Sequence
  EU545988.1 prME-long mRNA Design 1 GC
gggagaaagcuuaccaugcgcaucaucaacgcccggaaggagaagaagcgccggggcaccgacaccagcguggggaucgucggccugcuccugacgaccgccauggcgguggaggugacccgccggggguccgccuacuacauguaccuggaccgcagcgacgccggcgaggccaucuccuuccccaccacgcucgggaugaacaagugcuacauccagaucauggaccugggccacaugugcgacgccaccaugagcuacgagugcccgaugcuggacgagggcgucgagcccgacgacguggacugcuggugcaacaccaccuccacguggguggucuacgggaccugccaccacaagaagggcgaggcgcggcgcagccggcgcgccgugacccuccccucccacagcacccggaagcugcagacgcgcucccagaccuggcuggagagccgggaguacaccaagcaccucauccgcguggagaacuggaucuuccggaaccccggguucgcccuggccgcggccgccaucgccuggcugcucggcuccagcaccucccagaaggucaucuaccuggugaugauccugcucaucgccccggcguacagcauccgcugcaucgggguguccaaccgggacuucgucgagggcaugagcggcgggacguggguggacgugguccuggagcacggcgggugcgugaccgugauggcccaggacaagcccgccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucgccugcagcaagaagaugaccggcaaguccauccagcccgagaaccuggaguaccgcaucaugcugagcgugcacggcucccagcacagcgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgaguccaccgagaacagcaagaugaugcucgagcuggacccgcccuucggcgacuccuacaucgugaucggggugggcgagaagaagaucacccaccacuggcaccgcagcgggagcacgaucggcaaggccuucgaggccaccguccggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccguguccgccgacgucgggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3449 - RNA, 2359 nt, Artificial Sequence
  KU681082.3 prME-long mRNA Design 1 GC
gggagaaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucgggaugaacaagugcuacauccagaucauggaccugggccacaugugcgacgcgacgaugagcuacgagugcccgaugcuggacgagggcgucgagcccgacgacguggacugcuggugcaacaccaccuccaccuggguggucuacgggacgugccaccacaagaagggcgaggcccggcgcagccggcgcgccgugacccuccccucccacagcacccggaagcugcagacccgcucccagacguggcuggagagccgggaguacaccaagcaccucauccgcguggagaacuggaucuuccggaaccccggguucgcccuggcggccgccgucaucgccuggcugcucggcuccagcaccucccagaaggugaucuaccuggugaugauccugcucaucgccccggcguacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggccagcgacucccggugccccacccagggcgaggcguaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggccgaggcgacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuccagcgggcaccugaagugccggcugaagauggacaagcuccgccugaagggcgucuccuacagccugugcaccgccgccuucaccuucaccaagauccccgcggagacccuccacgggaccgugacgguggagguccaguacgccggcaccgacggccccugcaaggugccggcccagauggccguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcgggagcacgaucggcaaggcguucgaggccaccgugcggggcgccaagcgcauggccgugcugggggacaccgccugggacuucggcuccgucgggggcgcgcucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcccucggcggcgugcugaucuuccugagcaccgcggucuccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3450 - RNA, 2359 nt, Artificial Sequence
  KX601167.1 prME-long mRNA Design 1 GC
gggagaaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucaccuucaccaagauccccgccgagacccuccacgggaccgugacgguggagguccaguacgccggcaccgacggccccugcaaggugccggcccagauggccguggacaugcagacccugacccccgucgggcggcugaucacggcgaaccccgugaucaccgaguccaccgagaacagcaagaugaugcucgagcuggacccgcccuucggcgacuccuacaucgugaucggggucggcgacaagaagaucacccaccacugguaccgcagcgggagcacgaucggcaaggccuucgaggccaccgugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccgucuccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3451 - RNA, 2359 nt, Artificial Sequence
  KX694533.2 prME-long mRNA Design 1 GC
gggagaaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcaaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggagaucaccccgaacagcccccgggcggaggccacgcucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacaccggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucacguucaccaagauccccgccgagacccuccacgggaccgugaccguggagguccaguacgccggcacggacggccccugcaaggugccggcccagauggccguggacaugcagacccugacccccgucgggcggcugaucaccgcgaaccccgugaucacggaguccaccgagaacagcaagaugaugcucgagcuggacccgcccuucggcgacuccuacaucgugaucggggucggcgacaagaagaucacccaccacuggcaccgcagcgggagcaccaucggcaaggccuucgaggccacggugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacaccaagaacgggagcaucucccugacgugccuggcgcucggcggcgugcugaucuuccugagcaccgccgucuccgccgacguggggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3452 - RNA, 2359 nt, Artificial Sequence
  KY288905.1 prME-long mRNA Design 1 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggccacccucgggggcuucgggagccugggccuggacugcgagccccgcacgggccucgacuucuccgaccuguacuaccugaccaugaacaacaagcacuggcucgugcacaaggagugguuccacgacaucccccugcccuggcacgcgggggccgacaccggcaccccgcacuggaacaacaaggaggcccugguggaguucaaggacgcccacgccaagcggcagacggucguggugcucgggagccaggagggcgcgguccacaccgcccuggccggggcccuggaggcggagauggacggcgccaagggccgccucuucuccgggcaccugaagugccggcugaagauggacaagcuccgccugaagggcgugagcuacucccugugcaccgccgccuucaccuucaccaaggugcccgccgagacgcuccacgggaccgucaccguggaggugcaguacgcgggcaccgacggccccugcaagguccccgcccagauggccguggacaugcagacgcugaccccgguggggcggcugaucaccgccaaccccgucaucaccgagagcacggagaacuccaagaugaugcucgagcuggacccgcccuucggcgacagcuacaucgugaucggggugggcgacaagaagaucacccaccacuggcaccgcuccgggagcaccaucggcaaggccuucgaggcgaccguccggggcgccaagcgcauggccgugcugggggacacggccugggacuucggcagcgucgggggcguguucaacucccucgggaagggcauccaccagaucuucggcgccgcguucaagagccuguucgggggcauguccugguucagccagauccugaucgggacccugcucguguggcugggccugaacaccaagaacggguccaucagccugaccugccucgcccugggcggcgugaugaucuuccucuccacggccgucagcgccgacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3453 - RNA, 2359 nt, Artificial Sequence
  KF268950.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaaggucgaggugacccccaacuccccgcgggcggaggccacgcucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacaccggcacgccgcacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuucuccgggcaccugaagugccggcugaagauggacaagcuccgccugaagggcgugagcuacucccugugcaccgccgcguucacguucaccaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcgugcaccagaucuucggcgccgccuucaagagccuguucgggggcauguccugguucagccagauccugaucgggacccugcucgucuggcugggccugaacaccaagaacggguccaucagccucacgugccuggcccugggcggcgugaugaucuuccucuccaccgcggugagcgccgacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3454 - RNA, 2359 nt, Artificial Sequence
  KF383121.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaucggccacgagaccgacgagaaccgcgccaagguggaggugacccccaacuccccgcgggccgaggcgacccucgggggcuucgggagccugggccuggacugcgagccccgcaccggccucgacuucuccgaccuguacuaccugaccaugaacaacaagcacuggcucguccacaaggagugguuccacgacaucccccugcccuggcacgccggggccgacacgggcaccccgcacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuucuccgggcaccugaagugccggcugaagauggacaagcuccgccugaagggcgucagcuacucccugugcacggccgccuucaccuucaccaaggugcccgcggagacccuccacgggaccgugacggucgaggugcaguacgccggcaccgacggccccugcaaggugcccgcccagauggccgucgacaugcagacccugaccccgguggggcggcugaucacggccaaccccgugaucaccgagagcaccgagaacuccaagaugaugcucgagcuggacccgcccuucggcgacagcuacaucgucaucggggugggcgacaagaagaucacccaccacuggcaccgcuccgggagcacgaucggcaaggcguucgaggccaccgugcggggcgccaagcgcauggccguccugggggacaccgccugggacuucggcagcgucgggggcguguucaacucccucgggaagggcauccaccagaucuucggcgcggccuucaagagccuguucgggggcauguccugguucagccagauccugaucgggacccugcucguguggcugggccugaacacgaagaacggguccaucagccugaccugccucgcccugggcggcgugaugaucuuccucuccaccgccgugagcgcggacgucgggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3455 - RNA, 2341 nt, Artificial Sequence
  KF268949.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaaggucgaggugacccccaacuccccgcgggcggaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcccuggucgaguucaaggacgcgcacgccaagcggcagacgguggugguccucggcagccaggagggggccgugcacaccgcccuggcgggcgcccuggaggccgagauggacggggccaagggccgccucuucuccggccaccugaagugccggcugaagauggacaagcuccgccugaagggggugagcuacucccugugcaccgccgcguucaccuucacgaagguccccgccgagacccuccacggcaccgugaccguggagguccaguacgccgggaccgacggccccugcaaggugcccgcccagauggccguggacaugcagacgcugaccccggucggccggcugaucaccgcgaaccccgugaucaccgagagcacggagaacuccaagaugaugcucgagcuggacccgcccuucggggacagcuacaucgugaucggcgucggggacaagaagaucacccaccacuggcaccgcuccggcagcaccaucgggaaggccuucgaggccaccgugcggggcgccaagcgcauggccgugcugggcgacacggcgugggacuucgggagcgucggcgggguguucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgucaugaucuuccucuccacggcggugagcgccgacgugggcugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3456 - RNA, 2359 nt, Artificial Sequence
  KU955595.1 prME-long mRNA Design 1 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugacgaugaacaacaagcacuggcucgugcacaaggagugguuccacgacaucccccugcccuggcacgccggggccgacaccggcaccccgcacuggaacaacaaggaggcccugguggaguucaaggacgcccacgcgaagcggcagaccgucguggugcucgggagccaggagggcgccguccacacggcccuggccggggcgcuggaggccgagauggacggcgccaagggccgccucuucuccgggcaccugaagugccggcugaagauggacaagcuccgccugaagggcgugagcuacucccugugcaccgccgccuucaccuucaccaaggugcccgcggagacccuccacgggacggucaccguggaggugcaguacgccggcaccgacggccccugcaagguccccgcccagauggccguggacaugcagacccugacgccgguggggcggcugaucaccgccaaccccgucaucaccgagagcaccgagaacuccaagaugaugcucgagcuggacccgcccuucggcgacagcuacaucgugaucggggugggcgacaagaagaucacgcaccacuggcaccgcuccgggagcaccaucggcaaggcguucgaggccaccguccggggcgccaagcgcauggccgugcugggggacaccgccugggacuucggcagcgucgggggcguguucaacucccucgggaagggcauccaccagaucuucggcgcggccuucaagagccuguucgggggcauguccugguucagccagauccugaucgggacgcugcucguguggcugggccugaacaccaagaacggguccaucagccugaccugccucgcccugggcggcgugaugaucuuccucuccaccgccgucagcgcggacguggggugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3457 - RNA, 2359 nt, Artificial Sequence
  KF383116.1 prME-long mRNA Design 1 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccagcacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuucuccgggcaccugaagugccggcugaagauggacaagcuccgccugaagggcgugagcuacucccugugcacggccgugugcaccgccgcgaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcauccaccagaucuucggcgccgccuucaagagccuguucgggggcauguccugguucagccagauccugaucgggacccugcucguguggcugggccugaacaccaagaacggguccaucagccucacgugccuggcccugggcggcgucaugaucuuccucuccaccgcggugagcgccgacguggggugcuccgucgacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3458 - RNA, 2341 nt, Artificial Sequence
  KU963574.2 prME-long mRNA Design 1 GC
gggagaaagcuuaccaugcgcaucaucaacgcccggaaggagcgcaagcggcgcggcgccgacgcgagcaucgggaucgugucccugcuccugaccaccgucauggccgccgagaucacgcggcgcggcagcgccuacuacauguaccuggaccgguccgacgccgggaaggcgaucagcuucgugaccacccucggcgugaacaagugccacguccagaucauggaccuggggcacaugugcgacgccaccauguccuacgagugccccaugcuggacgagggcguggagcccgacgacguggacugcuggugcaacacgaccagcaccugggucguguacgggaccugccaccacaagaagggggaggcccgccggucccgccgggccgugacgcuccccagccacuccacccgcaagcugcagacccggagccagaccuggcuggagucccgcgaguacacgaagcaccucaucaaggucgagaacuggaucuuccggaaccccggcuucgcgcugguggccguggccaucgccuggcugcucgggagcuccaccagccagaaggucaucuaccuggugaugauccugcucaucgcccccgcguacuccauccgcugcaucggcgugagcaaccgggacuucgucgaggggauguccggcggcaccuggguggacgugguccuggagcacgggggcugcgugaccgugauggcccaggacaagccgacggucgacaucgagcuggugaccaccaccgugagcaacauggccgagguccgcuccuacugcuacgaggccagcaucagcgacauggccuccgacagccggugccccacgcagggggaggcguaccucgacaagcaguccgacacccaguacgugugcaagcgcacccuggucgaccggggcuggggcaacgggugcggccuguucgggaagggcagccucgugaccugcgccaaguucacgugcuccaagaagaugaccggcaagagcauccagcccgagaaccuggaguaccgcaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgcggacaccgagaccccgcacuggaacaacaaggaggcccugguggaguucaaggacgcccacgccaagcggcagacgguggucgugcucggcagccaggagggggccgugcacaccgcgcuggccggcgcccuggaggccgagauggacggggcgaagggccgccucuccagcgggcaccugaagugccggcugaagauggacaagcuccgccugaagggcgucuccuacagccugugcaccgccgccuucaccuucacgaaggugcccgccgagacccuccacggcaccgugaccgucgaggugcaguacgccgggcgggacggccccugcaaggugcccgcgcagauggccgucgacaugcagacccugacgccgguggggcgccugaucaccgccaaccccgugaucaccgaguccaccgagaacagcaagaugaugcucgagcuggacccgcccuucggcgacagcuacaucgucaucggcgugggggacaagaagaucacgcaccacuggcaccgguccggcagcaucaucgggaaggccuucgaggccaccgugcgcggcgcgaagcggauggccguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcgcucgggggcgugaugaucuuccucagcaccgccguguccgccgacgucgggugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3459 - RNA, 2341 nt, Artificial Sequence
  KX601166.1 prME-long mRNA Design 1 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggcgacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgccgacaccgggacgccgcacuggaacaacaaggaggcccugguggaguucaaggacgcccacgcgaagcggcagaccgucguggugcucggcagccaggagggggccguccacaccgcccuggccggcgcgcuggaggccgagauggacggggccaagggccgccucuucuccggccaccugaagugccggcugaagauggacaagcuccgccugaagggggugagcuacucccugugcaccgccgccuucacguucaccaaggugcccgcggagacccuccacggcaccgucaccguggaggugcaguacgccgggacggacggccccugcaagguccccgcccagauggccguggacaugcagacccugaccccggugggccggcugaucaccgccaaccccgucaucacggagagcaccgagaacuccaagaugaugcucgagcuggacccgcccuucggggacagcuacaucgugaucggcgugggggacaagaagaucacccaccacuggcaccgcuccggcagcaccaucgggaaggcguucgaggccacgguccggggcgccaagcgcauggccgugcugggcgacaccgccugggacuucgggagcgugggcggggucuucaacucccucggcaaggggauccaccagaucuucggcgcggccuucaagagccuguucggcgggauguccugguucagccagauccugaucggcacccugcucguguggcuggggcugaacaccaagaacggcuccaucagccucacgugccuggcccucgggggcgugaugaucuuccuguccaccgccgucagcgcggacgugggcugcuccguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3460 - RNA, 2359 nt, Artificial Sequence
  KF383118.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgagacccgccggagccgccgguccgugagccuccgcuaccacuacacccggaagcugcagacccgcucccagacguggcuggagagccgggaguacaagaagcaccucaucauggucgagaacuggaucuuccgcaaccccggguucgccaucguguccguggcgaucaccuggcugaugggcagccugaccucccagaaggucaucuaccucgugaugaucgugcugaucguccccgccuacagcaucuccugcaucggggugagcaaccgggaccugguggagggcauguccggcgggaccugggucgacguggugcucgagcacggcgggugcgucacggagauggcccaggacaagcccaccguggacaucgagcuggugaccaugaccgucagcaacauggccgaggugcgcuccuacugcuacgaggccagccugagcgacauggcguccgccagccggugcccgacgcagggcgagcccucccucgacaagcagagcgacacccaguccgugugcaagcgcacccugggcgaccggggguggggcaacgggugcggcaucuucgggaagggcagccuggugaccugcuccaaguucacgugcugcaagaagaugcccggcaagagcauccagcccgagaaccucgaguaccgcaucaugcugccgguccacgggucccagcacagcggcaugaucgucaacgacaucgggcacgagaccgacgagaaccgcgccaagguggaggugacccccaacagcccccgggccgaggccacccugggcggguucggcucccucggccuggacugcgagccccgcacggggcuggacuucuccgaccucuacuaccugaccaugaacaacaagcacuggcugguccacaaggagugguuccacgacaucccgcuccccuggcacgcgggcgccgacaccgggacgccccacuggaacaacaaggaggcccugguggaguucaaggacgcccacgccaagcggcagaccguggucgugcugggcagccaggagggggcggugcacaccgcccucgccggcgcccuggaggccgagauggacggcgcgaaggggcgccuguucuccggccaccucaagugccggcugaagauggacaagcugcgccucaagggggucagcuacucccugugcaccgccgccuucaccuucacgaaggugcccgccgagacccugcacggcaccgugaccgucgaggugcagagcgcgggcaccgacgggccgugcaaggugcccgcccagauggccgucgacaugcagacgcucacccccgugggccggcugaucaccgccaaccccgugaucaccgaguccacggagaacagcaagaugaugcuggagcucgacccgcccuucggggacagcuacaucgucaucggcgugggggacaagaagaucacccaccacuggcaccgcuccggcagcaccaucggcaaggccuucgaggcgaccgugcgcggggccaagcggauggccguccugggcgacacggccugggacuucggguccgugggcgggguguucaacagccugggcaagggcauccaccagaucuucggggccgcguucaagucccucuucggcgggaugagcugguucucccagauccugaucggcacccugcuggucuggcucgggcugaacaccaagaacggcagcaucucccugaccugccucgcccugggcggggugaugaucuuccugagcacggccguguccgccgacgucggcugcagcguggacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3461 - RNA, 2353 nt, Artificial Sequence
  KF383120.1 prME-long mRNA Design 1 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccgccccagccggcgcgcggugacccugcccucccacagcacccggaagcuccagacccgcucccagacguggcuggagagccgggaguacaccaagcaccugaucaaggucgagaacuggauccuccgcaaccccggguucaccguggccgcccuggccauggccuggcugcucggcaacuccaccagccagcgggugaucuaccuggucaugauccugcucaucgcgccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggccagcaucuccgacauggcgagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucacgugcuccaagaagaugaccggcaagagcauccagcccgagaaccuggaguaccgcaucaugcuguccguccacggcagccagcacuccgggaugaucgugaacgacaucggccacgagaccgacgagaaccgcgccaaggucgaggugaccccgaacagcccccgggccgaggcgacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcccuggucgaguucaaggacgcccacgcgaagcggcagaccguggugguccucgggucccaggagggcgccgugcacaccgcccuggccggggcgcuggaggccgagauggacggcgccaagggccgccucuucagcgggcaccugaagugccggaucaagauggacaagcugcgccucaagggcguguccuacagccugugcaccgccgccuucaccuucuccaagguccccgcggagacccugcacgggaccgugacgguggagguccaguacgccggccgggacggccccugcaaggugccggcccagauggccguggacaugcagacccucacccccgucgggcgccugaucaccgccaaccccaucaucacggagagcaccgagaacucccggaugaugcuggagcucgacccgcccuucggcgacagcuacaucgugaucggggugggcgacaagaagaucacccaccacuggcaccgcuccgggagcaccaucggcaaggcguucgaggccacgguccggggcgccaagcgcauggccgugcugggggacaccgccugggacuucggcagcgucgggggcguguucaacucccuggggaagggcgugcaccagguguucggcgcggccuucaagagccucuucgggggcauguccugguucagccagauccugaucgggacccugcuggucuggcucggccugaacaccaagaacggguccaucagccuggccugccucgcccugggcggcgcgaugaucuuccuguccacggccgugagcgccgacguggggugcuccgucgacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3462 - RNA, 2284 nt, Artificial Sequence; identical to SEQ ID NO: 3297
  KU321639.1 prME-short mRNA Design 1 GC

SEQ ID NO: 3463 - RNA, 2284 nt, Artificial Sequence; identical to SEQ ID NO: 3298
  KU312312.1 prME-short mRNA Design 1 GC

SEQ ID NO: 3464 - RNA, 2272 nt, Artificial Sequence; identical to SEQ ID NO: 3299
  AY632535.2 prME-short mRNA Design 1 GC

SEQ ID NO: 3465 - RNA, 2284 nt, Artificial Sequence; identical to SEQ ID NO: 3300
  KU527068.1 prME-short mRNA Design 1 GC

SEQ ID NO: 3466 - RNA, 2284 nt, Artificial Sequence
  KX421193.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaccggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3467 - RNA, 2284 nt, Artificial Sequence
  KX377335.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccggaagaagggggaggcccgccggagccgccgggccgugacccuccccucccacagcacccgcaagcugcagacccggucccagacguggcuggagagccgcgaguacaccaagcaccucaucaaggucgagaacuggaucuuccggaaccccggcuucgcccugguggcgguggccaucgccuggcugcucggguccagcaccucccagaaggucaucuaccuggugaugauccugcucaucgcccccgccuacagcauccgcugcaucggcguguccaaccgggacuucgucgaggggaugagcggcggcaccuggguggacgugguccuggagcacgggggcugcgugacggugauggcgcaggacaagccgaccgucgacaucgagcuggugaccaccacgguguccaacauggccgagguccgcagcuacugcuacgaggccuccaucagcgacauggccagcgacucccggugccccacccagggggaggccuaccucgacaagcagagcgacacccaguacgugugcaagcgcacccugguggaccggggcuggggcaacgggugcggccuguucgggaagggcucccucgucacgugcgcgaaguucacgugcagcaagaagaugaccgggaaguccauccagcccgagaaccuggaguaccgcaucaugcugagcgugcacggcucccagcacagcggcaugaucgucaacgacaccggguacgagaccgacgagaaccgggccaagguggaggugacccccaacuccccgcgcgccgaggccacccucggcggguucggcagccuggggcuggacugcgagccccggaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcgccagaccguggucgugcucggcagccaggagggggccgugcacacggcgcuggccggcgcccuggaggccgagauggacggggcgaagggcaagcuguucuccggccaccugaagugccgccugaagauggacaagcuccggcugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccgccugaucaccgccaaccccgugaucaccgagagcaccgagaacuccaagaugaugcucgagcuggacccgcccuucggggacagcuacaucgucaucggcgugggggacaagaagaucacgcaccacuggcaccgguccggcagcaccaucgggaaggccuucgaggccaccgugcgcggcgccaagcggauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3468 - RNA, 2284 nt, Artificial Sequence
  LC002520.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaccgucaacgacaucggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3469 - RNA, 2266 nt, Artificial Sequence
  DQ859059.1 prME-short mRNA Design 1 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgcgaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgccgacacgggcaccccgcacuggaacaacaaggaggcgcugguggaguucaaggacgcccacgccaagcggcagaccgucguggugcucgggagccaggagggcgccguccacaccgcccuggcgggggcccuggaggccgagauggacggcgccaaggggcgccucuucuccggccaccugaagugccgccugaagauggacaagcuccggcugaagggcgugagcuacucccugugcacggcggccuucaccuucaccaaggugcccgccgagacccuccacgggaccgucacgguggaggugcaguacgccggcaccgacgggcccugcaagguccccgcccagauggcgguggacaugcagacccugaccccggugggccgccugaucacggccaaccccgucaucaccgagagcaccgagaacuccaagaugaugcucgagcuggacccgcccuucggcgacagcuacaucgugaucggggugggcgacaagaagaucacccaccacuggcaccgguccgggagcacgaucggcaaggccuucgaggccaccguccgcggggccaagcggauggcggugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacacgaagaacggguccaucagccugaccugccucgcccugggcggggugaugaucuuccucuccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3470 - RNA, 2272 nt, Artificial Sequence
  KU963573.2 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucggguacgagaccgacgagaaccgcgccaaggucgaggugacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccuggucgaguucaaggacgcccacgccaagcggcagaccguggugguccucggcagccaggagggggccgugcacaccgcgcuggccggcgcccuggaggccgagauggacggggcgaagggcaagcuguucuccggccaccugaagugccgccugaagauggacaagcuccgccugaagggggugagcuacucccugugcacggccgccuucaccuucaccaagguccccgccgagacccuccacggcaccgugacgguggagguccaguacgccgggaccgacggccccugcaagauccccgugcagauggcgguggacaugcagacccugaccccggucggccggcugaucacggccaaccccgugaucaccgagagcaccgagaacuccaagaugaugcucgagcuggacccgcccuucggggacagcuacaucgugaucggcgucggggacaagaagaucacccaccacuggcaccgcuccggcagcacgaucgggaaggccuucgaggccaccgugcggggcgccaagcgcauggcggugcugggcgacaccgccugggacuucgggagcgucggcgggguguucaacucccucggcaaggggauccaccagaucuucggcgccgccuucaagagccuguucggcgggauguccugguucagccagauccugaucggcacccugcucguguggcuggggcugaacacgaagaacggcuccaucagccugaccugccucgcccucgggggcgucaugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3471 - RNA, 2284 nt, Artificial Sequence
  KX694534.2 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggccgggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3472 - RNA, 2284 nt, Artificial Sequence
  KX369547.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggccuggcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3473 - RNA, 2284 nt, Artificial Sequence
  KX447515.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacugguaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3474 - RNA, 2284 nt, Artificial Sequence
  KU729218.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacacccagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3475 - RNA, 2284 nt, Artificial Sequence
  KU501217.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgagauccgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3476 - RNA, 2284 nt, Artificial Sequence
  KU312314.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugcuggcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3477 - RNA, 2284 nt, Artificial Sequence
  KX446950.2 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgacccuggacgagggcguggagcccgacgacgucgacugcuggugcaacaccaccagcacgugggugguguacgggaccugccaccacaagaagggggaggcgcggcgcucccggcgcgccgucacccuccccagccacuccacccggaagcugcagacgcgcagccagaccuggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcacgugggucgacguggugcuggagcacgggggcugcgucaccgugauggcccaggacaagcccaccguggacaucgagcuggucaccacgaccgugagcaacauggccgaggugcgcuccuacugcuacgaggccagcaucuccgacauggccagcgacagccggugccccacccagggggaggcguaccucgacaagcaguccgacacccaguacgucugcaagcgcacgcugguggaccggggcuggggcaacgggugcggccuguucgggaagggcagccucgugaccugcgccaaguucgccugcuccaagaagaugaccggcaagagcauccagcccgagaaccuggaguaccgcaucaugcuguccguccacggcagccagcacuccggcaugaucgugaacgacaccgggcacgagacggacgagaaccgggccaaggucgagaucaccccgaacagcccccgcgccgaggcgacccucggcggguucggcucccuggggcuggacugcgagccccggaccggccucgacuucagcgaccuguacuaccugacgaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3478 - RNA, 2284 nt, Artificial Sequence
  KY003157.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgucgugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3479 - RNA, 2284 nt, Artificial Sequence
  KX811222.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcgcgugggugguguacgggaccugccaccacaagaagggcgaggcccggcgcucccggcgcgccgucacgcuccccagccacuccacccggaagcugcagacccgcccccagaccuggcuggagagccgggaguacacgaagcaccucauccgcguggagaacuggaucuuccggaacccgggcuucgcccuggcggccgccgccaucgccuggcugcucggguccagcaccucccagaaggugaucuaccuggucaugauccugcucaucgcgcccgccuacagcauccgcugcaucggcguguccaaccgggacuucguggaggggaugagcggcggcaccugggucgacguggugcuggagcacgggggcugcgucaccgugauggcccaggacaagcccacgguggacaucgagcuggucaccaccaccguguccaacauggccgaggugcgcagcuacugcuacgaggccuccaucagcgacauggcguccgacagccggugccccacgcagggggaggccuaccucgacaagcagagcgacacccaguacgucugcaagcgcacccugguggaccggggcuggggcaacgggugcggccuguucgggaagggcucccucgugaccugcgccaaguucgccugcagcaagaagaugacggggaaguccauccagccggagaaccuggaguaccgcaucaugcugagcguccacggcucccagcacagcggcaugaucgugaacgacaccgggcacgagaccgacgagaaccgggccaaggucgagaucacccccaacagcccccgcgcggaggccacgcucggcggguucggcucccuggggcuggacugcgagccccggaccggccucgacuucuccgaccuguacuaccugaccaugaacaacaagcacuggcucgugcacaaggagugguuccacgacaucccgcugcccuggcacgccggcgccgacaccgggacgccccacuggaacaacaaggaggcccugguggaguucaaggacgcgcacgccaagcgccagaccgucguggugcucggcagccaggagggggccguccacaccgcccuggcgggcgcccuggaggccgagauggacggggccaagggccgccucuccagcggccaccugaagugccggcugaagauggacaagcuccgccugaaggggguguccuacagccugugcaccgccgcguucacguucaccaagauccccgccgagacccuccacggcaccgugaccgucgaggugcaguacgccgggacggacggcccgugcaaggugcccgcccagauggccgucgacaugcagacccugacccccgugggccggcugaucaccgcgaaccccgugaucacggaguccaccgagaacagcaagaugaugcucgagcuggacccgcccuucggggacuccuacaucgucaucggcgugggggagaagaagaucacccaccacuggcaccgcagcggcuccaccaucgggaaggccuucgaggccacggugcggggcgccaagcgcauggccguccugggcgacaccgcgugggacuucgggagcgugggcggggcccucaacagccugggcaaggggauccaccagaucuucggcgccgccuucaagucccuguucggcgggaugagcugguucucccagauccugaucggcacccuccugauguggcuggggcucaacaccaagaacggcagcaucucccugaugugccuggcgcucgggggcgugcugaucuuccugagcacggccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3480 - RNA, 2284 nt, Artificial Sequence
  KX447516.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagcaagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3481 - RNA, 2284 nt, Artificial Sequence
  KX520666.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccacccgccagaaggugaucuaccuggucaugauccugcucaucgccccggcguacagcauccggugcaucggcguguccaaccgcgacuucguggaggggaugagcggcggcaccugggucgacguggugcuggagcacgggggcugcgucacggugauggcccaggacaagcccaccguggacaucgagcuggucaccaccacgguguccaacauggccgaggugcggagcuacugcuacgaggccuccaucagcgacauggccuccgacagccgcugccccacccagggggaggcguaccucgacaagcagagcgacacccaguacgucugcaagcggacccugguggaccgcggcuggggcaacgggugcggccuguucgggaagggcucccucgugacgugcgccaaguucgccugcagcaagaagaugaccgggaaguccauccagcccgagaaccuggaguaccggaucaugcugagcguccacggcucccagcacagcggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccggcucuccagcggccaccugaagugccgccugaagauggacaagcuccggcugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucgggaaggcguucgaggccaccgugcgcggcgccaagcggauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3482 - RNA, 2284 nt, Artificial Sequence
  KU497555.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcacccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcuccaccaucgggaaggcguucgaggccaccgugcggggcgccaagcgcauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacgcuccugauguggcuggggcucaacaccaagaacggcagcaucucccugaugugccuggcccucgggggcgugcugaucuuccugagcaccgcggucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3483 - RNA, 2284 nt, Artificial Sequence
  KY075939.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacucccugcgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3484 - RNA, 2284 nt, Artificial Sequence
  KY075932.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcaucgagaacuggaucuuccggaaccccggcuucgcccuggccgcggccgccaucgccuggcugcucgggagcuccaccagccagaaggugaucuaccuggugaugauccugcucaucgccccggcguacuccauccgcugcaucggcgucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3485 - RNA, 2284 nt, Artificial Sequence
  KU870645.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauccugcggaaccccggcuucgcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcaucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3486 - RNA, 2284 nt, Artificial Sequence
  KU729217.2 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucagcaccaccguguccaacauggccgaggugcgcagcuacugcuacgaggccacgaucuccgacaucgccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgccgucgugcucggcucccaggagggggccgugcacaccgcccuggcgggcgcccuggaggccgagauggacggggccaagggccgccucagcuccggccaccugaagugccggcugaagauggacaagcuccgccugaagggggucagcuacucccugugcaccgccgcguucaccuucaccaagauccccgccgagacccuccacggcaccgugacgguggagguccaguacgccgggaccgacggccccugcaaggugccggcccagauggccguggacaugcagacccugacccccgucggccggcugaucacggcgaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggccuucgaggccaccgugcggggcgccaagcgcauggccgugcugggcgacaccgcgugggacuucgggagcgucggcggggcccucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcgcucgggggcgugcugaucuuccuguccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3487 - RNA, 2284 nt, Artificial Sequence
  KX087101.3 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgagcugcaguacgccgggaccgacggccccugcaaggugccggcccagauggccguggacaugcagacccugacccccgucggccggcucaucacggccaaccccgugaucaccgagagcaccgagaacuccaagaugaugcuggagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3488 - RNA, 2284 nt, Artificial Sequence
  KY014317.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaucgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3489 - RNA, 2284 nt, Artificial Sequence
  KU758876.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggugaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagcuucaugugccuggcccucgggggcguccugaucuuccuguccaccgccgugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3490 - RNA, 2284 nt, Artificial Sequence
  KU758874.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggcaagcucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3491 - RNA, 2284 nt, Artificial Sequence
  KY317939.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaaggacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3492 - RNA, 2284 nt, Artificial Sequence
  KY014314.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggaggcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3493 - RNA, 2284 nt, Artificial Sequence
  KX447517.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcggcccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagacccugaucggcacccuccugauguggcuggggcucaacacgaagaacggcuccaucagccugaugugccuggcgcucgggggcgugcugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3494 - RNA, 2284 nt, Artificial Sequence
  KU926310.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccggggccgacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3495 - RNA, 2284 nt, Artificial Sequence
  KU922923.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgcccuggcguacuccauccgcugcaucggcgugagcaaccgggacuucguggaggggauguccggcggcaccugggucgacguggugcuggagcacgggggcugcgucacggugauggcccaggacaagccgaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgcccaacagcccgcgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugcccuggcacgccggcgccgacacggggaccccgcacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcacggccgccuucaccuucaccaagauccccgcggagacccugcacggcaccgugacggucgaggugcaguacgccgggaccgacggccccugcaaggugcccgcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3496 - RNA, 2284 nt, Artificial Sequence
  KY075937.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggucagcgacagccggugccccacccagggggaggccuaccucgacaagcaguccgacacccaguacgugugcaagcgcacccugguggaccggggcuggggcaacgggugcggccuguucgggaagggcagccucgucacgugcgcgaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggccacccucggcggguucggcucccuggggcuggacugcgagccccggaccggccucgacuucagcgaccuguacuaccugaccaugaacaacaagcacuggcucgugcacaaggagugguuccacgacaucccccugccguggcacgcgggcgccgacacggggacgccccacuggaacaacaaggaggcccuggucgaguucaaggacgcccacgccaagcgccagaccguggugguccucggcucccaggagggggcggugcacaccgcccuggccggcgcccuggaggcggagauggacggggccaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagccugaugugccuggcccucgggggcguccugaucuuccuguccaccgccgugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3497 - RNA, 2284 nt, Artificial Sequence
  KY003156.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcaucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcauccuggggcuggacugcgagccccggaccggccucgacuucuccgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcagccaggagggggccgugcacaccgcccuggccggcgcgcuggaggccgagauggacggggccaagggccgccucuccagcggccaccugaagugccggcugaagauggacaagcuccgccugaagggggucuccuacagccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcuccacgaucgggaaggcguucgaggccaccgugcggggcgccaagcgcauggccgugcugggcgacaccgccugggacuucgggagcgucggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3498 - RNA, 2284 nt, Artificial Sequence
  KU312313.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacacgugcgacgccaccauguccuacgagugcccgaugcuggacgagggcguggagcccgacgacgucgacugcuggugcaacaccaccagcacgugggugguguacgggaccugccaccacaagaagggggaggcgcggcgcucccggcgcgccgucacccuccccagccacuccauccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacggcagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacgccaagaacggcuccaucagccugaugugccuggcgcucgggggcgugcugaucuuccuguccacggccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3499 - RNA, 2284 nt, Artificial Sequence
  KY075935.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcagcggucccgccgggccgucacccuccccagccacuccacccgcaagcugcagacccggagccagacguggcuggagucccgcgaguacaccaagcaccucauccggguggagaacuggaucuuccgcaaccccggcuucgcccuggccgcggccgccaucgccuggcugcucgggagcuccaccagccagaaggugaucuaccuggucaugauccugcucaucgccccggcguacuccauccggugcaucggcgugagcaaccgcgacuucguggaggggauguccggcggcaccugggucgacguggugcuggagcacgggggcugcgucacggugauggcccaggacaagcccaccguggacaucgagcuggucaccaccacggugagcaacauggccgaggugcgguccuacugcuacgaggccagcaucuccgacauggccagcgacagccgcugccccacccagggggaggcguaccucgacaagcaguccgacacccaguacgucugcaagcggacccugguggaccgcggcuggggcaacgggugcggccuguucgggaagggcagccucgugacgugcgccaaguucgccugcuccaagaagaugaccggcaagagcauccagcccgagaaccuggaguaccggaucaugcuguccguccacgggagccagcacuccggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcggcagaccgucguggugcucggcucccaggagggggccguccacaccgcccuggccggcgcgcuggaggccgagauggacggggccaagggccgccucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3500 - RNA, 2284 nt, Artificial Sequence
  KY014320.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcaggcccgcagccagaccuggcuggagucccgggaguacacgaagcaccucauccgcguggagaacuggaucuuccggaaccccggcuucgcccuggcggccgccgccaucgccuggcugcucgggagcuccaccagccagaaggugaucuaccuggucaugauccugcucaucgcgccggccuacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggcgagcgacagccggugccccacgcagggggaggccuaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacgggagccagcacuccggcaugaucgugaacgacaccgggcacgagaccgacgagaaccgggccaaggucgagaucaccccgaacagcccccgcgcggaggccacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3501 - RNA, 2284 nt, Artificial Sequence
  KY328290.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucuccaagauccccgcggagacccuccacggcaccgugaccgaggagguccaguacgccgggacggacggccccugcaaggugccggcccagauggccguggacaugcagacccugacccccgucggccggcugaucaccgccaaccccgugaucacggagagcaccgagaacuccaagaugaugcucgagcuggacccgcccuucggggacagcuacaucgugaucggcgucggggagaagaagaucacccaccacuggcaccgcagcggcuccaccaucgggaaggcguucgaggccacggugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3502 - RNA, 2284 nt, Artificial Sequence
  KU681081.3 prME-short mRNA Design 1 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacacgggcgccgacaccgggacgccccacuggaacaacaaggaggcccugguggaguucaaggacgcccacgccaagcgccagaccgucguggugcucggcagccaggagggggcgguccacaccgcccuggccggcgcccuggaggcggagauggacggggccaagggccgccucuccagcggccaccugaagugccggcugaagauggacaagcuccgccugaaggggguguccuacagccugugcaccgccgccuucaccuucaccaagauccccgccgagacccuccacggcacggugaccgucgaggugcaguacgcggggaccgacggccccugcaaggugccggcccagauggccgucgacaugcagacccugacgcccgugggccggcugaucaccgccaaccccgugaucaccgaggggaccgagaacuccaagaugaugcucgagcuggacccgcccuucggcgacagcuacaucgucaucggggugggcgagaagaagaucacgcaccacuggcaccgcuccgggagcaccaucggcaaggccuucgaggcgaccgugcggggcgccaagcgcauggccguccugggggacaccgccugggacuucggcagcgucgggggcgugcucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3503 - RNA, 2284 nt, Artificial Sequence
  KX827309.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3504 - RNA, 2284 nt, Artificial Sequence
  KU955593.1 prME-short mRNA Design 1 GC
gggagaaagcuuaccaugaccagcgugggcaucgucgggcugcuccugaccacggccauggccguggaggugacccgccggggcaacgcguacuacauguaccuggaccgcuccgacgccggggaggccaucagcuuccccaccaccaugggcaugaacaagugcuacauccagaucauggaccucgggcacaugugcgacgccacgauguccuacgagugcccgaugcuggacgagggcgucgagcccgacgacguggacugcuggugcaacaccaccagcaccuggguggucuacggcacgugccaccacaagaagggggaggcccggcgcucccggcgcgcggugacccugcccagccacuccacccggaagcuccagacccgcagccagacguggcuggagucccgggaguacaccaagcaccugauccgcguggagaacuggaucuuccggaaccccggcuucgcccucgccgccgcggccaucgccuggcugcuggggagcuccaccagccagaaggucaucuaccucgugaugauccugcugaucgccccggccuacuccauccgcugcaucggcgugagcaaccgggacuucgucgaggggauguccggcggcaccuggguggacgugguccucgagcacgggggcugcgugacggugauggcgcaggacaagcccaccgucgacaucgagcuggugaccaccacggugagcaacauggccgagguccgcuccuacugcuacgaggccagcaucuccgacauggccagcgacagccggugccccacccagggggaggccuaccuggacaagcaguccgacacccaguacgugugcaagcgcacccucguggaccggggcuggggcaacgggugcggccuguucgggaagggcagccuggucacgugcgcgaaguucgccugcuccaagaagaugaccggcaagagcauccagcccgagaaccucgaguaccgcaucaugcuguccgugcacgggagccagcacuccggcaugaucgucaacgacaccgggcacgagaccgacgagaaccgggccaagguggagaucacgccgaacagcccccgcgccgaggccacccugggcggguucggcucccucgggcuggacugcgagccccggaccggccuggacuucagcgaccucuacuaccugaccaugaacaacaagcacuggcuggugcacaaggagugguuccacgacaucccccucccguggcacgcgggcgccgacacggggacgccccacuggaacaacaaggaggcccuggucgaguucaaggacgcccacgccaagcgccagaccguggugguccugggcucccaggagggggcggugcacaccgcccucgccggcgcccuggaggcggagauggacggggccaagggccgccugagcuccggccaccucaagugccggcugaagauggacaagcugcgccucaagggggugagcuacucccugugcaccgccgccuucaccuucaccaagauccccgccgagacccugcacggcaccgucacgguggaggugcaguacgcggggaccgacggccccugcaaggucccggcccagauggccguggacaugcagacccucacccccgugggccggcugaucacggccaaccccgucaucaccgagagcaccgagaacuccaagaugaugcuggagcucgacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccugaacucccucggcaaggggauccaccagaucuucggcgcggccuucaagagccuguucggcgggauguccugguucagccagauccugaucggcacccugcucgucuggcuggggcugaacacgaagaacggcuccaucagccucaugugccuggcccucgggggcgugcugaucuuccuguccaccgccgugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3505 - RNA, 2284 nt, Artificial Sequence
  KY272987.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccuggugugccuggcccucgggggcguccugaucuuccugagcaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3506 - RNA, 2284 nt, Artificial Sequence
  KY007221.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcgugaacaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccuggugugccuggcccucgggggcguccugaucuuccuguccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3507 - RNA, 2284 nt, Artificial Sequence
  EU545988.1 prME-short mRNA Design 1 GC
gggagaaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggccaucgccuggcugcucggguccagcaccucccagaaggucaucuaccuggugaugauccugcucaucgccccggccuacagcauccgcugcaucggcguguccaaccgggacuucgucgaggggaugagcggcggcaccuggguggacgugguccuggagcacgggggcugcgugacggugauggcgcaggacaagcccgccgucgacaucgagcuggugaccaccaccguguccaacauggccgagguccgcagcuacugcuacgaggccuccaucagcgacauggccagcgacucccggugccccacgcagggggaggcguaccucgacaagcagagcgacacccaguacgugugcaagcgcacccugguggaccggggcuggggcaacgggugcggccuguucgggaagggcucccucgugaccugcgccaaguucgccugcagcaagaagaugacggggaaguccauccagcccgagaaccuggaguaccgcaucaugcugagcguccacggcucccagcacagcggcaugaucgucaacgacaccgggcacgagaccgacgagaaccgggccaagguggagaucaccccgaacagcccccgcgccgaggcgacgcucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacaccgggacgccccacuggaacaacaaggaggcccuggucgaguucaaggacgcccacgcgaagcgccagaccguggugguccucggcagccaggagggggccgugcacaccgcccuggccggcgcgcuggaggccgagauggacggggccaagggccgccucuccagcggccaccugaagugccggcugaagauggacaagcuccgccugaaggggguguccuacagccugugcaccgccgccuucacguucaccaagauccccgcggagacccuccacggcaccgucaccguggaggugcaguacgccgggacggacggccccugcaaggucccggcccagauggccguggacaugcagacccugacccccgugggccggcugaucaccgccaaccccgucaucacggaguccaccgagaacagcaagaugaugcucgagcuggacccgcccuucggggacuccuacaucgugaucggcgugggggagaagaagaucacccaccacuggcaccgcagcggcagcaccaucgggaaggcguucgaggccacgguccggggcgccaagcgcauggccgugcugggcgacaccgccugggacuucggguccgugggcggggcgcucaacagccugggcaaggggauccaccagaucuucggcgccgccuucaagucccuguucggcgggaugagcugguucucccagauccugaucggcacccuccuggucuggcuggggcucaacaccaagaacggcagcaucucccugacgugccuggcccucgggggcgugcugaucuuccugagcaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3508 - RNA, 2284 nt, Artificial Sequence
  KU681082.3 prME-short mRNA Design 1 GC
gggagaaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggucaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcccaggacaagcccaccguggacaucgagcuggugaccaccacggucuccaacauggcggaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgccaaguucgcgugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgccggcgcggacacggggacgccccacuggaacaacaaggaggcccugguggaguucaaggacgcccacgccaagcgccagaccguggucgugcucggcagccaggagggggccgugcacaccgcgcuggccggcgcccuggaggccgagauggacggggcgaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgccgggaccgacggccccugcaaggugccggcgcagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcagcacgaucgggaaggccuucgaggccaccgugcggggcgcgaagcgcauggccgugcugggcgacaccgccugggacuucggguccgucggcggggcccucaacagccugggcaaggggauccaccagaucuucggcgccgcguucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3509 - RNA, 2284 nt, Artificial Sequence
  KX601167.1 prME-short mRNA Design 1 GC
gggagaaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacacggggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgcggggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggacaagaagaucacccaccacugguaccgcagcggcagcacgaucgggaaggccuucgaggcgaccgugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3510 - RNA, 2284 nt, Artificial Sequence
  KX694533.2 prME-short mRNA Design 1 GC
gggagaaagcuuaccaugaccagcgugggcaucgucgggcugcuccugaccacggccauggccguggaggugacccgccggggcuccgcguacuacauguaccuggaccgcagcgacgccgggaaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaucgggcacgagaccgacgagaaccgggccaagguggagaucaccccgaacagcccccgcgccgaggccacgcucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacaccgggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucacguucaccaagauccccgccgagacccuccacggcaccgugaccguggagguccaguacgcggggacggacggccccugcaaggugccggcccagauggccguggacaugcagacccugacccccgucggccggcugaucaccgccaaccccgugaucacggaguccaccgagaacagcaagaugaugcucgagcuggacccgcccuucggggacuccuacaucgugaucggcgucggggacaagaagaucacccaccacuggcaccgcagcggcagcaccaucgggaaggccuucgaggcgacggugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacaccaagaacggcagcaucucccugacgugccuggcccucgggggcgugcugaucuuccugagcaccgccgucuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3511 - RNA, 2284 nt, Artificial Sequence
  KY288905.1 prME-short mRNA Design 1 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgcgaagguggaggucacccccaacuccccgcgggccgaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcgcugguggaguucaaggacgcccacgccaagcggcagacggucguggugcucggcagccaggagggggccguccacaccgcccuggcgggcgcccuggaggccgagauggacggggccaagggccgccucuucuccggccaccugaagugccgccugaagauggacaagcuccggcugaagggggugagcuacucccugugcaccgcggccuucaccuucaccaaggugcccgccgagacgcuccacggcaccgucaccguggaggugcaguacgccgggaccgacggccccugcaagguccccgcccagauggcgguggacaugcagacgcugaccccggugggccgccugaucaccgccaaccccgucaucaccgagagcacggagaacuccaagaugaugcucgagcuggacccgcccuucggggacagcuacaucgugaucggcgugggggacaagaagaucacccaccacuggcaccgguccggcagcaccaucgggaaggccuucgaggccaccguccgcggcgccaagcggauggcggugcugggcgacacggccugggacuucgggagcgugggcggggucuucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgugaugaucuuccucuccacggcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3512 - RNA, 2284 nt, Artificial Sequence
  KF268950.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggggaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaaggucgaggugacccccaacuccccgcgggccgaggccacgcucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacaccgggacgccgcacuggaacaacaaggaggcccuggucgaguucaaggacgcccacgccaagcggcagaccguggugguccucggcagccaggagggggcggugcacaccgcccuggccggcgcccuggaggcggagauggacggggccaagggccgccucuucuccggccaccugaagugccgccugaagauggacaagcuccggcugaagggggugagcuacucccugugcaccgccgccuucacguucaccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaagggggugcaccagaucuucggcgccgcguucaagagccuguucggcgggauguccugguucagccagauccugaucggcacccugcucgucuggcuggggcugaacaccaagaacggcuccaucagccucacgugccuggcccugggcggcgugaugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3513 - RNA, 2284 nt, Artificial Sequence
  KF383121.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaucgggcacgagaccgacgagaaccgcgccaagguggaggugacccccaacuccccgcgggccgaggccacccucggcggguucggcagccuggggcuggacugcgagccccgcaccggccucgacuucuccgaccuguacuaccugaccaugaacaacaagcacuggcucguccacaaggagugguuccacgacaucccccugcccuggcacgccggcgcggacacggggaccccgcacuggaacaacaaggaggcccugguggaguucaaggacgcccacgccaagcggcagaccguggucgugcucggcagccaggagggggccgugcacaccgcgcuggccggcgcccuggaggccgagauggacggggcgaagggccgccucuucuccggccaccugaagugccgccugaagauggacaagcuccggcugaagggggucagcuacucccugugcacggccgccuucaccuucaccaaggugcccgccgagacccuccacggcaccgugacggucgaggugcaguacgccgggaccgacggccccugcaaggugcccgcgcagauggccgucgacaugcagacccugaccccggugggccgccugaucacggccaaccccgugaucaccgagagcaccgagaacuccaagaugaugcucgagcuggacccgcccuucggggacagcuacaucgucaucggcgugggggacaagaagaucacccaccacuggcaccgguccggcagcacgaucgggaaggccuucgaggccaccgugcgcggcgcgaagcggauggccguccugggcgacaccgccugggacuucgggagcgugggcgggguguucaacucccucggcaaggggauccaccagaucuucggcgccgccuucaagagccuguucggcgggauguccugguucagccagauccugaucggcacccugcucgucuggcuggggcugaacacgaagaacggcuccaucagccugaccugccuggcgcucgggggcgugaugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3514 - RNA, 2266 nt, Artificial Sequence
  KF268949.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggcgaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgccaaggucgaggugacccccaacuccccgcgggccgaggccacccucgggggcuucgggagccugggccuggacugcgagccccgcacggggcucgacuucuccgaccuguacuaccugaccaugaacaacaagcacuggcucgugcacaaggagugguuccacgacaucccccugcccuggcacgcgggcgccgacaccggcaccccgcacuggaacaacaaggaggcccuggucgaguucaaggacgcccacgccaagcggcagacgguggugguccucgggagccaggagggcgcggugcacaccgcccuggccggggcccuggaggcggagauggacggcgccaaggggcgccucuucuccggccaccugaagugccgccugaagauggacaagcuccggcugaagggcgugagcuacucccugugcaccgccgccuucaccuucacgaagguccccgccgagacccuccacgggaccgugaccguggagguccaguacgcgggcaccgacgggcccugcaaggugcccgcccagauggccguggacaugcagacgcugaccccggucggccgccugaucaccgccaaccccgugaucaccgagagcacggagaacuccaagaugaugcucgagcuggacccgcccuucggcgacagcuacaucgugaucggggucggcgacaagaagaucacccaccacuggcaccgguccgggagcaccaucggcaaggccuucgaggcgaccgugcgcggggccaagcggauggccgugcugggcgacacggccugggacuucggcagcgucgggggcguguucaacucccucgggaagggcauccaccagaucuucggggccgcguucaagagccuguucggcggcauguccugguucagccagauccugaucgggacccugcucguguggcugggccugaacaccaagaacggguccaucagccugaccugccucgcccugggcggggucaugaucuuccucuccacggccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3515 - RNA, 2284 nt, Artificial Sequence
  KU955595.1 prME-short mRNA Design 1 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugacgaugaacaacaagcacuggcucgugcacaaggagugguuccacgacaucccccugcccuggcacgccggcgcggacaccgggaccccgcacuggaacaacaaggaggcccugguggaguucaaggacgcccacgccaagcggcagaccgucguggugcucggcagccaggagggggccguccacacggcgcuggccggcgcccuggaggccgagauggacggggcgaagggccgccucuucuccggccaccugaagugccgccugaagauggacaagcuccggcugaagggggugagcuacucccugugcaccgccgccuucaccuucaccaaggugcccgccgagacccuccacggcacggucaccguggaggugcaguacgccgggaccgacggccccugcaagguccccgcgcagauggccguggacaugcagacccugacgccggugggccgccugaucaccgccaaccccgucaucaccgagagcaccgagaacuccaagaugaugcucgagcuggacccgcccuucggggacagcuacaucgugaucggcgugggggacaagaagaucacgcaccacuggcaccgguccggcagcaccaucgggaaggccuucgaggccaccguccgcggcgcgaagcggauggccgugcugggcgacaccgccugggacuucgggagcgugggcggggucuucaacucccucggcaaggggauccaccagaucuucggcgccgccuucaagagccuguucggcgggauguccugguucagccagauccugaucggcacgcugcucguguggcuggggcugaacaccaagaacggcuccaucagccugaccugccuggcgcucgggggcgugaugaucuuccucuccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3516 - RNA, 2284 nt, Artificial Sequence
  KF383116.1 prME-short mRNA Design 1 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccagcacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccugguggaguucaaggacgcccacgccaagcggcagaccgucguggugcucggcagccaggagggggccguccacaccgcgcuggccggcgcccuggaggccgagauggacggggcgaagggccgccucuucuccggccaccugaagugccgccugaagauggacaagcuccggcugaagggggugagcuacucccugugcacggccgugugcaccgccgccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaaggggauccaccagaucuucggcgccgcguucaagagccuguucggcgggauguccugguucagccagauccugaucggcacccugcucguguggcuggggcugaacaccaagaacggcuccaucagccucacgugccuggcccucgggggcgucaugaucuuccuguccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3517 - RNA, 2266 nt, Artificial Sequence
  KX601166.1 prME-short mRNA Design 1 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacgagaaccgcgccaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgcggacaccggcacgccgcacuggaacaacaaggaggcccugguggaguucaaggacgcccacgccaagcggcagaccgucguggugcucgggagccaggagggcgccguccacaccgcgcuggccggggcccuggaggccgagauggacggcgcgaaggggcgccucuucuccggccaccugaagugccgccugaagauggacaagcuccggcugaagggcgugagcuacucccugugcaccgccgccuucacguucaccaaggugcccgccgagacccuccacgggaccgucaccguggaggugcaguacgccggcacggacgggcccugcaagguccccgcgcagauggccguggacaugcagacccugaccccggugggccgccugaucaccgccaaccccgucaucacggagagcaccgagaacuccaagaugaugcucgagcuggacccgcccuucggcgacagcuacaucgugaucggggugggcgacaagaagaucacccaccacuggcaccgguccgggagcaccaucggcaaggccuucgaggccacgguccgcggggcgaagcggauggccgugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacaccaagaacggguccaucagccucacgugccuggcgcugggcggggugaugaucuuccucuccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3518 - RNA, 2284 nt, Artificial Sequence
  KF383118.1 prME-short mRNA Design 1 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagccggacgacguggacugcuggugcaacaccaccuccaccugggucguguacggcacgugccaccacaagaagggggagacccggcgcagccggcgcuccgugagccuccgguaccacuacacccgcaagcugcagacccggucccagacguggcuggagagccgcgaguacaagaagcaccucaucauggucgagaacuggaucuuccggaaccccggcuucgccaucguguccguggccaucaccuggcugauggggagccugaccucccagaaggucaucuaccucgugaugaucgugcugaucguccccgccuacagcaucuccugcaucggcgugagcaaccgcgaccugguggaggggauguccggcggcaccugggucgacguggugcucgagcacgggggcugcgucacggagauggcgcaggacaagcccaccguggacaucgagcuggugaccaugaccgucagcaacauggccgaggugcgguccuacugcuacgaggccagccugagcgacauggccuccgccagccgcugcccgacgcagggggagcccucccucgacaagcagagcgacacccaguccgugugcaagcggacccugggcgaccgcggcugggggaacggcugcgggaucuucggcaaggggagccuggugaccugcuccaaguucacgugcugcaagaagaugcccggcaagagcauccagcccgagaaccucgaguaccggaucaugcugccggugcacggcucccagcacagcgggaugaucgucaacgacaucggccacgagaccgacgagaaccgcgcgaagguggaggugacccccaacagcccccgggccgaggccacccucgggggcuucgggucccugggccuggacugcgagccccgcacgggccuggacuucuccgaccucuacuaccugaccaugaacaacaagcacuggcugguccacaaggagugguuccacgacaucccgcuccccuggcacgccggggccgacaccggcacgccccacuggaacaacaaggaggcgcugguggaguucaaggacgcccacgccaagcggcagaccguggucgugcuggggagccaggagggcgccgugcacaccgcccucgcgggggcccuggaggccgagauggacggcgccaagggccgccuguucuccgggcaccucaagugccgccugaagauggacaagcugcggcucaagggcgucagcuacucccugugcaccgccgcguucaccuucacgaaggugcccgccgagacccugcacgggaccgugaccgucgaggugcagagcgccggcaccgacggcccgugcaaggugcccgcccagauggcggucgacaugcagacgcucacccccguggggcgccugaucaccgccaaccccgugaucaccgaguccacggagaacagcaagaugaugcuggagcucgacccgcccuucggcgacagcuacaucgucaucggggugggcgacaagaagaucacccaccacuggcaccgguccgggagcaccaucggcaaggccuucgaggccaccgugcgcggcgccaagcggauggcgguccugggggacacggccugggacuucggcuccgucgggggcguguucaacagccuggggaagggcauccaccagaucuucggcgccgccuucaagucccucuucgggggcaugagcugguucucccagauccugaucgggacccugcuggucuggcucggccugaacaccaagaacgggagcaucucccugaccugccucgcccugggcggcgugaugaucuuccugagcacggcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3519 - RNA, 2281 nt, Artificial Sequence
  KX447520.1 prME-short mRNA Design 1 GC
gggagaaagcuuaccaugagcgugggcaucgucgggcugcuccugaccaccgccauggccgcggaggugacgcgccggggcuccgccuacuacauguaccuggaccgcaacgacgccggggaggccaucagcuuccccaccacccucggcaugaacaagugcuacauccagaucauggaccuggggcacaugugcgacgccaccauguccuacgagugcccgaugcuggacgagggcguggagcccgacgacgucgacugcuggugcaacacgaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3520 - RNA, 2284 nt, Artificial Sequence
  KU761561.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgcccgccggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3521 - RNA, 2284 nt, Artificial Sequence
  KX806557.2 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauguuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3522 - RNA, 2284 nt, Artificial Sequence
  LC191864.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaugaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3523 - RNA, 2284 nt, Artificial Sequence
  KU744693.1 prME-short mRNA Design 1 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggccauggcccaggacaagcccaccguggacaucgagcuggugaccaccacggucagcaacauggccgaggugcgcuccuacugcuacgaggccagcaucuccgacauggcgagcgacagccggugccccacccagggggaggccuaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugcucgucaacgacaccgggcacgagaccgacgagaaccgggccaagguggagaucacgccgaacagcccccgcgcggaggccacccugggcggguucggcucccuggggcucgacugcgagccccggaccggccuggacuucagcgaccuguacuaccucaccaugaacaacaagcacuggcuggcccacaaggagugguuccacgacaucccccugccguggcacgccggcgccgcgacggggacgccccacuggaacaacaaggaggcccucgucgaguucaaggacgcccacgccaagcgccagaccguggugguccugggcucccaggagggggcggugcacaccgcccuggccggcgcccucgaggccgagauggacggggcgaagggccgccugagcuccggccaccugaagugccggcucaagauggacaagcugcgccugaagggggugagcuacucccucugcaccgccgccuucaccuucaccaagauccccgccgagaccgucgacggcaccgugacgguggaggggcaguacggcggcaccgacgggcccugcaaggucccggcccagauggcgguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucggcaaggccuucgaggccaccguccgcggggccaagcggauggcggugcugggcgacaccgccugggacuucgggagcgugggcggggcccucaacucccugggcaagggcauccaccagaucaucggggccgcguucaagagccuguucggcgggauguccugguucagccagauccugaucggcacccuccugauguggcuggggcucaacacgaagaacggcuccaucagccugaugugccuggcccucggcgggguccugaucuuccuguccaccgccgugagcggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3524 - RNA, 2275 nt, Artificial Sequence
  KU963574.2 prME-short mRNA Design 1 GC
gggagaaagcuuaccaugggcgccgacgccagcaucgggaucgugucccugcuccugaccaccgucauggcggccgagaucacgcgccggggcagcgccuacuacauguaccuggaccgcuccgacgccgggaaggccaucagcuucgugaccacccucggcgugaacaagugccacguccagaucauggaccuggggcacaugugcgacgcgaccauguccuacgagugccccaugcuggacgagggcguggagcccgacgacguggacugcuggugcaacacgaccagcaccugggucguguacgggaccugccaccacaagaagggggaggcccggcgcucccggcgcgccgugacgcuccccagccacuccacccggaagcugcagacccgcagccagaccuggcuggagucccgggaguacacgaagcaccucaucaaggucgagaacuggaucuuccgcaaccccggcuucgcccugguggcgguggccaucgccuggcugcucgggagcuccaccagccagaaggucaucuaccuggugaugauccugcucaucgcccccgccuacuccauccggugcaucggcgugagcaaccgcgacuucgucgaggggauguccggcggcaccuggguggacgugguccuggagcacgggggcugcgugaccgugauggcgcaggacaagccgacggucgacaucgagcuggugaccaccaccgugagcaacauggccgagguccgguccuacugcuacgaggccagcaucagcgacauggccuccgacagccgcugccccacgcagggggaggccuaccucgacaagcaguccgacacccaguacgugugcaagcggacccuggucgaccgcggcuggggcaacgggugcggccuguucgggaagggcagccucgugaccugcgcgaaguucacgugcuccaagaagaugaccggcaagagcauccagcccgagaaccuggaguaccggaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgccgacaccgagaccccgcacuggaacaacaaggaggcgcugguggaguucaaggacgcccacgccaagcggcagacgguggucgugcucggcagccaggagggggccgugcacaccgcccuggcgggcgcccuggaggccgagauggacggggccaagggccgccucuccagcgggcaccugaagugccgccugaagauggacaagcuccggcugaagggcgucuccuacagccugugcaccgcggccuucaccuucacgaaggugcccgccgagacccuccacggcaccgugaccgucgaggugcaguacgccgggcgcgacggccccugcaaggugcccgcccagauggcggucgacaugcagacccugacgccgguggggcggcugaucaccgccaaccccgugaucaccgaguccaccgagaacagcaagaugaugcucgagcuggacccgcccuucggcgacagcuacaucgucaucggcgugggggacaagaagaucacgcaccacuggcaccgcuccggcagcaucaucgggaaggccuucgaggccaccgugcggggcgccaagcgcauggcgguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcccucgggggcgugaugaucuuccucagcaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3525 - RNA, 2293 nt, Artificial Sequence
  KF383120.1 prME-short mRNA Design 1 GC
gggagaaagcuuaccaugggcgccgacaccagcaucgggaucaucggccugcuccugaccacggccauggcggccgagaucacccgccggggguccgccuacuacauguaccuggaccgcagcgacgccggcaaggccaucuccuucgcgaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccggcccagccgccgggccgugacccugcccucccacagcacccgcaagcuccagacccggucccagacguggcuggagagccgcgaguacaccaagcaccugaucaaggucgagaacuggauccuccggaaccccggguucaccguggcggcccuggccauggccuggcugcucggcaacuccaccagccagcgcgugaucuaccuggucaugauccugcucaucgccccggcguacuccauccggugcaucggggugagcaaccgcgacuucguggagggcauguccggcgggacgugggucgacguggugcuggagcacggcgggugcgucaccgugauggcccaggacaagcccaccguggacaucgagcuggucaccacgaccgugagcaacauggccgaggugcgguccuacugcuacgaggccagcaucuccgacauggccagcgacagccgcugccccacccagggcgaggcguaccucgacaagcaguccgacacccaguacgucugcaagcggacgcugguggaccgcggcugggggaacggcugcgggcuguucggcaaggggagccucgugaccugcgccaaguucacgugcuccaagaagaugaccggcaagagcauccagcccgagaaccuggaguaccggaucaugcuguccguccacggcagccagcacuccgggaugaucgugaacgacaucggccacgagaccgacgagaaccgcgccaaggucgaggugaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgcgggggccgacaccggcacgccccacuggaacaacaaggaggcccuggucgaguucaaggacgcccacgccaagcggcagaccguggugguccucgggucccaggagggcgcggugcacaccgcccuggccggggcccuggaggcggagauggacggcgccaagggccgccucuucagcgggcaccugaagugccgcaucaagauggacaagcugcggcucaagggcguguccuacagccugugcaccgccgccuucaccuucuccaagguccccgccgagacccugcacgggaccgugacgguggagguccaguacgcgggccgcgacggccccugcaaggugccggcccagauggccguggacaugcagacccucacccccgucgggcggcugaucaccgccaaccccaucaucacggagagcaccgagaacucccgcaugaugcuggagcucgacccgcccuucggcgacagcuacaucgugaucggggugggcgacaagaagaucacccaccacuggcaccgguccgggagcaccaucggcaaggccuucgaggcgacgguccgcggcgccaagcggauggccgugcugggggacaccgccugggacuucggcagcgucgggggcguguucaacucccuggggaagggcgugcaccagguguucggcgccgcguucaagagccucuucgggggcauguccugguucagccagauccugaucgggacccugcuggucuggcucggccugaacaccaagaacggguccaucagccuggccugccucgcccugggcggcgccaugaucuuccuguccacggcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3526 - RNA, 1576 nt, Artificial Sequence; identical to SEQ ID NO: 249
  KU321639.1 solE mRNA Design 1 GC

SEQ ID NO: 3527 - RNA, 1576 nt, Artificial Sequence; identical to SEQ ID NO: 254
  KU312312.1 solE mRNA Design 1 GC

SEQ ID NO: 3528 - RNA, 1564 nt, Artificial Sequence; identical to SEQ ID NO: 259
  AY632535.2 solE mRNA Design 1 GC

SEQ ID NO: 3529 - RNA, 1576 nt, Artificial Sequence; identical to SEQ ID NO: 3304
  KU527068.1 solE mRNA Design 1 GC

SEQ ID NO: 3530 - RNA, 1576 nt, Artificial Sequence
  KX421193.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3531 - RNA, 1576 nt, Artificial Sequence
  LC002520.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaccgugaacgacaucggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3532 - RNA, 1558 nt, Artificial Sequence
  DQ859059.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacgcgggcgccgacaccgggaccccgcacuggaacaacaaggaggcccucguggaguucaaggacgcccacgccaagcgccagacggucguggugcugggcagccaggagggggcgguccacaccgcccuggccggcgcccucgaggccgagauggacggcgcgaaggggcggcuguucagcggccaccugaagugccgccucaagauggacaagcugcggcugaaggggguguccuacagccucugcaccgccgccuucaccuucacgaagguccccgccgagacccugcacggcaccgugaccguggagguccaguacgccgggacggacggccccugcaaggugcccgcgcagauggccguggacaugcagacccugaccccggucggccgccucaucaccgccaaccccgugaucacggaguccaccgagaacagcaagaugaugcuggagcuggacccgcccuucggggacuccuacaucgugaucggcgucggggacaagaagaucacccaccacuggcaccggagcggcuccaccaucgggaaggccuucgaggccacggugcgcggcgcgaagcggauggccgugcucggcgacaccgccugggacuucgggagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3533 - RNA, 1564 nt, Artificial Sequence
  KU963573.2 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgagaaccgggccaagguggaggugacccccaacuccccgcgcgccgaggccacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggcaagcuguucagcgggcaccugaagugccggcucaagauggacaagcugcgccugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcggcucaucacggccaaccccgucaucaccgaguccaccgagaacagcaagaugaugcuggagcuggacccgcccuucggcgacuccuacaucgugaucggggugggcgacaagaagaucacccaccacuggcaccgcagcggguccacgaucggcaaggccuucgaggccaccguccggggcgccaagcgcauggcggugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3534 - RNA, 1576 nt, Artificial Sequence
  KY075939.1 solE mRNA Design 1 GC
gggagaaagcuuaccaugagccagaaggugaucuaccuggucaugauccuccugaucgcccccgccuacucccugcgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacuccccgcgcgccgaggcgacgcucgggggcuucggcagccuggggcuggacugcgagccccggaccggccuggacuucuccgaccucuacuaccugaccaugaacaacaagcacuggcugguccacaaggagugguuccacgacaucccccuccccuggcacgccggggccgacaccggcacgccgcacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagauccccgccgagacccugcacgggaccgugacggucgaggugcaguacgcgggcaccgacggccccugcaaggugcccgcccagauggccgucgacaugcagacccucaccccgguggggcgccugaucacggccaaccccgugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3535 - RNA, 1576 nt, Artificial Sequence
  KX447516.1 solE mRNA Design 1 GC
gggagaaagcuuaccaugagcaagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3536 - RNA, 1576 nt, Artificial Sequence
  KX447515.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacugguaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3537 - RNA, 1576 nt, Artificial Sequence
  KU758874.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggcaagcugagcuccgggcaccugaagugccggcucaagauggacaagcugcgccugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggcgaccgugcggggcgccaagcgcauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3538 - RNA, 1576 nt, Artificial Sequence
  KU729218.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacacccagacccugacgccgguggggcgccucaucaccgccaaccccgugaucaccgagagcaccgagaacuccaagaugaugcuggagcuggacccgcccuucggcgacagcuacaucgucaucggggugggcgagaagaagaucacgcaccacuggcaccgguccgggagcaccaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3539 - RNA, 1576 nt, Artificial Sequence
  KU501217.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgagauccgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3540 - RNA, 1576 nt, Artificial Sequence
  KU761561.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgcccggcgcauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3541 - RNA, 1576 nt, Artificial Sequence
  KY075937.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggucagcgacucccggugccccacgcagggcgaggccuaccuggacaagcagagcgacacccaguacgugugcaagcgcacccugguggaccggggcugggggaacggcugcgggcuguucggcaaggggucccuggugaccugcgccaaguucgcgugcagcaagaagaugacgggcaaguccauccagcccgagaaccuggaguaccgcaucaugcucagcguccacggcucccagcacagcgggaugaucgugaacgacaccggccacgagaccgacgagaaccgggccaaggucgagaucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3542 - RNA, 1576 nt, Artificial Sequence
  KY014317.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaucgagaacuccaagaugaugcuggagcuggacccgcccuucggcgacagcuacaucgucaucggggugggcgagaagaagaucacccaccacuggcaccgguccgggagcaccaucggcaaggccuucgaggcgacggugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3543 - RNA, 1576 nt, Artificial Sequence
  KU870645.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucgggaucggcgagaagaagaucacccaccacuggcaccgguccgggagcacgaucggcaaggccuucgaggcgaccgugcgcggcgccaagcggauggccgugcucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3544 - RNA, 1576 nt, Artificial Sequence
  KU922923.1 solE mRNA Design 1 GC
gggagaaagcuuaccaugagccagaaggugaucuaccuggucaugauccuccugaucgcccuggccuacuccauccgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacagcccccgcgccgaggcgacgcucgggggcuucggcucccuggggcuggacugcgagccgcggaccggccuggacuucuccgaccucuacuaccugaccaugaacaacaagcacuggcugguccacaaggagugguuccacgacaucccccuccccuggcacgccggggccgacaccggcacgccccacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagaucccggccgagacccugcacgggaccgugacggucgaggugcaguacgcgggcaccgacggccccugcaaggugcccgcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3545 - RNA, 1576 nt, Artificial Sequence
  KU497555.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggacccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcacggccgccuucaccuucaccaagauccccgccgagacccugcacgggacggugaccgucgaggugcaguacgcgggcaccgacggccccugcaaggugcccgcccagauggccgucgacaugcagacccugacgccgguggggcgccucaucaccgccaaccccgugaucaccgaguccaccgagaacagcaagaugaugcuggagcuggacccgcccuucggcgacuccuacaucgucaucggggugggcgagaagaagaucacgcaccacuggcaccggagcggguccaccaucggcaaggccuucgaggcgaccgugcgcggcgccaagcggauggccguccucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3546 - RNA, 1576 nt, Artificial Sequence
  KU312314.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcuggcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3547 - RNA, 1576 nt, Artificial Sequence
  KY014314.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggaggcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3548 - RNA, 1576 nt, Artificial Sequence
  KX447517.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcggcccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3549 - RNA, 1576 nt, Artificial Sequence
  KU729217.2 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucagcaccaccguguccaacauggccgaggugcgcagcuacugcuacgaggccaccaucuccgacaucgccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccgccgugguccuggggagccaggagggcgccgugcacaccgcccuggccggcgcgcucgaggccgagauggacggggccaagggccggcugagcuccgggcaccugaagugccgccucaagauggacaagcugcggcugaagggcgugagcuacucccucugcaccgccgccuucacguucaccaagauccccgcggagacccugcacgggaccgucacgguggagguccaguacgccggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggcguucgaggccaccgugcgcggcgccaagcggauggccgugcucggggacaccgcgugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3550 - RNA, 1576 nt, Artificial Sequence
  KY328290.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucagcaagauccccgccgagacccugcacgggaccgugaccgaggagguccaguacgcgggcacggacggccccugcaaggugcccgcccagauggccguggacaugcagacccugaccccggucgggcgccucaucaccgccaaccccgugaucacggaguccaccgagaacagcaagaugaugcuggagcuggacccgcccuucggcgacuccuacaucgugaucggggucggcgagaagaagaucacccaccacuggcaccggagcggguccaccaucggcaaggccuucgaggcgacggugcgcggcgccaagcggauggccgugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3551 - RNA, 1576 nt, Artificial Sequence
  KX087101.3 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgagcugcaguacgcgggcaccgacggccccugcaaggugcccgcccagauggccguggacaugcagacccucaccccggucgggcgccugaucacggccaaccccgugaucaccgagagcaccgagaacuccaagaugaugcuggagcucgacccgcccuucggcgacagcuacaucgugaucggggucggcgagaagaagaucacccaccacuggcaccgguccgggagcacgaucggcaaggccuucgaggcgaccgugcgcggcgccaagcggauggccgugcugggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3552 - RNA, 1576 nt, Artificial Sequence
  KY003156.1 solE mRNA Design 1 GC
gggagaaagcuuaccaugagccagaaggugaucuaccuggucaugauccuccugaucgcccccgccuacuccauccgcugcaucggcaucagcaaccgggacuucguggaggggauguccggcgggaccuggguggacgucgugcuggagcacggcgggugcgugaccgucauggcgcaggacaagcccacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcauccuggggcucgacugcgagccccggaccggccuggacuucagcgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggucccaggagggcgccgugcacaccgcccuggccggcgcccucgaggcggagauggacggggccaagggccggcugagcagcgggcaccugaagugccgccucaagauggacaagcugcggcugaagggcguguccuacagccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgagaagaagaucacccaccacuggcaccggagcggguccacgaucggcaaggccuucgaggcgaccgugcgcggcgccaagcggauggccgugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3553 - RNA, 1576 nt, Artificial Sequence
  KU758876.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggucaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3554 - RNA, 1576 nt, Artificial Sequence
  KU926310.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcgccgacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3555 - RNA, 1576 nt, Artificial Sequence
  KU681081.3 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacaccggggccgacacgggcaccccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcugagcuccgggcaccugaagugccgccucaagauggacaagcugcggcugaagggcgucagcuacucccucugcacggccgccuucaccuucaccaagauccccgccgagacccugcacgggacggugaccgucgaggugcaguacgccggcaccgacggccccugcaaggugcccgcgcagauggccgucgacaugcagacccugacgccgguggggcgccucaucaccgccaaccccgugaucaccgagggcaccgagaacagcaagaugaugcuggagcuggacccgcccuucggggacuccuacaucgucaucggcgugggggagaagaagaucacgcaccacuggcaccggagcggcuccaccaucggcaaggccuucgaggccaccgugcgcggggcgaagcggauggccguccucggcgacaccgccugggacuucgggagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3556 - RNA, 1576 nt, Artificial Sequence
  KU744693.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgcgauggcccaggacaagcccacgguggacaucgagcucgugaccaccaccgucagcaacauggccgaggugcgcuccuacugcuacgaggccagcaucuccgacauggccagcgacucccggugccccacgcagggcgaggcguaccuggacaagcagagcgacacccaguacgugugcaagcgcacccuggucgaccggggcugggggaacggcugcgggcuguucggcaaggggucccuggugaccugcgccaaguucgccugcagcaagaagaugacgggcaaguccauccagcccgagaaccuggaguaccgcaucaugcucagcgugcacggcucccagcacagcgggaugcuggucaacgacaccggccacgagaccgacgagaaccgggccaagguggagaucacccccaacuccccgcgcgcggaggccacgcucgggggcuucggcagccucgggcuggacugcgagccccggaccggccuggacuucuccgaccucuacuaccugaccaugaacaacaagcacuggcuggcccacaaggagugguuccacgacaucccccuccccuggcacgccggggccgcgaccggcacgccgcacuggaacaacaaggaggcccugguggaguucaaggacgcccacgccaagcgccagaccgucguggugcuggggagccaggagggcgccguccacaccgcgcucgccggcgcccuggaggccgagauggacggggccaagggccggcugagcuccgggcaccucaagugccgccugaagauggacaagcugcggcucaagggcgugagcuacucccugugcaccgcggccuucacguucaccaagauccccgccgagaccguggacgggaccgucacgguggagggccaguacggcgggaccgacggccccugcaagguccccgcccagauggccguggacaugcagacccugaccccgguggggcgccucaucacggcgaaccccgucaucaccgagagcaccgagaacuccaagaugaugcuggagcuggacccgcccuucggcgacagcuacaucgugaucggggugggcgagaagaagaucacccaccacuggcaccgguccggcagcacgaucgggaaggccuucgaggccaccguccgcggcgccaagcggauggcggugcucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3557 - RNA, 1576 nt, Artificial Sequence
  EU545988.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccgccguggacaucgagcucgucacgaccaccgugagcaacauggccgaggugcgcuccuacugcuacgaggccagcaucuccgacauggccagcgacucccggugccccacccagggcgaggcguaccuggacaagcagagcgacacgcaguacgucugcaagcgcacccugguggaccggggcugggggaacggcugcgggcuguucggcaaggggucccuggugaccugcgccaaguucgccugcagcaagaagaugaccggcaaguccauccagcccgagaaccuggaguaccgcaucaugcucagcguccacggcucccagcacagcgggaugaucgugaacgacacgggccacgagaccgacgagaaccgggccaagguggagaucacccccaacuccccgcgcgcggaggccacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3558 - RNA, 1576 nt, Artificial Sequence
  KY007221.1 solE mRNA Design 1 GC
gggagaaagcuuaccaugagccagaaggugaucuaccuggucaugauccuccugaucgcccccgccuacuccauccgcugcaucggcgugaacaaccgggacuucguggaggggaugagcggcgggaccugggucgacguggugcuggagcacggcgggugcgucaccgugauggcgcaggacaagcccacgguggacaucgagcucgucaccaccaccguguccaacauggccgaggugcgcagcuacugcuacgaggccuccaucagcgacauggccuccgacagccggugccccacgcagggcgaggccuaccuggacaagcaguccgacacccaguacgucugcaagcgcacccugguggaccggggcugggggaacggcugcgggcuguucggcaaggggagccuggugaccugcgcgaaguucgccugcuccaagaagaugacgggcaagagcauccagcccgagaaccuggaguaccgcaucaugcucuccguccacggcagccagcacuccgggaugaucgugaacgacaccggccacgagaccgacgagaaccgggccaagguggagaucacccccaacagcccgcgcgccgaggcgacgcucgggggcuucggcucccuggggcucgacugcgagccccggaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggucccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgaguccaccgagaacagcaagaugaugcuggagcuggacccgcccuucggcgacuccuacaucgucaucggggugggcgagaagaagaucacccaccacuggcaccggagcggguccacgaucggcaaggccuucgaggcgaccgugcgcggcgccaagcggauggccguccucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3559 - RNA, 1576 nt, Artificial Sequence
  KY003152.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcgccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3560 - RNA, 1576 nt, Artificial Sequence
  KX694533.2 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaucggccacgagaccgacgagaaccgggccaagguggagaucacccccaacuccccgcgcgccgaggcgacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcccacgcgaagcgccagacgguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucaccuucacgaagauccccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgacaagaagaucacccaccacuggcaccgguccgggagcaccaucggcaaggccuucgaggcgacggugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3561 - RNA, 1576 nt, Artificial Sequence
  KX601167.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgacaagaagaucacccaccacugguaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3562 - RNA, 1576 nt, Artificial Sequence
  KY288905.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggccacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcacggccgccuucaccuucaccaagguccccgccgagacccugcacgggacggugaccguggagguccaguacgccggcaccgacggccccugcaaggugcccgcgcagauggccguggacaugcagacccugacgccggucgggcgccucaucaccgccaaccccgugaucaccgaguccaccgagaacagcaagaugaugcuggagcuggacccgcccuucggcgacuccuacaucgugaucggggucggcgacaagaagaucacgcaccacuggcaccggagcggguccaccaucggcaaggccuucgaggccaccgugcgcggcgcgaagcggauggccgugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3563 - RNA, 1576 nt, Artificial Sequence
  KF268950.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgccuucacguucaccaagguccccgccgagacccugcacgggaccgugacgguggagguccaguacgccggcaccgacggccccugcaaggugcccgcgcagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgacaagaagaucacccaccacuggcaccggagcggguccacgaucggcaaggccuucgaggccaccgugcgcggcgcgaagcggauggccgugcucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3564 - RNA, 1576 nt, Artificial Sequence
  KF383116.1 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgucugcacggccgccaaggugcccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggaguccaccgagaacagcaagaugaugcuggagcuggacccgcccuucggcgacuccuacaucgucaucggggugggcgacaagaagaucacccaccacuggcaccggagcggguccaccaucggcaaggccuucgaggcgacggugcgcggcgccaagcggauggccguccucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3565 - RNA, 1558 nt, Artificial Sequence
  KU963574.2 solE mRNA Design 1 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacagcggcgcggacaccgagaccccgcacuggaacaacaaggaggcccucguggaguucaaggacgcccacgccaagcgccagacggucguggugcuggggagccaggagggcgccguccacaccgcgcuggccggggcccucgaggccgagauggacggcgccaagggccggcuguccagcgggcaccugaagugccgccucaagauggacaagcugcggcugaagggcguguccuacagccucugcaccgcggccuucaccuucacgaagguccccgccgagacccugcacgggaccgugaccguggagguccaguacgccggccgcgacgggcccugcaaggugcccgcccagauggcgguggacaugcagacgcugaccccggucggccggcucaucaccgccaaccccgugaucaccgaguccacggagaacagcaagaugaugcuggagcuggacccgcccuucggcgacuccuacaucgugaucggggucggcgacaagaagaucacccaccacuggcaccgcagcggguccaucaucggcaaggccuucgaggccaccgugcgcggggccaagcggauggcggugcucggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3566 - RNA, 1576 nt, Artificial Sequence
  KF383118.1 solE mRNA Design 1 GC
gggagaaagcuuaccaugagccagaaggugaucuaccuggucaugaucgugcucaucgugcccgccuacuccaucagcugcaucggcgucuccaaccgcgaccugguggaggggaugagcggcgggaccuggguggacgucgugcuggagcacggcgggugcgugaccgagauggcccaggacaagcccacggucgacaucgagcucgugaccaugaccguguccaacauggcggagguccggagcuacugcuacgaggccucccugagcgacauggccuccgccagccgcugccccacccagggcgagcccucccuggacaagcagagcgacacgcaguccgugugcaagcggacccucggcgaccgcggguggggcaacgggugcggcaucuucgggaagggcagccuggugaccugcuccaaguucacgugcugcaagaagaugcccggcaagagcauccagccggagaaccuggaguaccggaucaugcuccccguccacgggucccagcacagcggcaugaucgugaacgacaucgggcacgagaccgacgagaaccgcgccaagguggaggucacccccaacagcccccgggcggaggccacccugggcggcuucgggucccugggccucgacugcgagccgcgcaccgggcuggacuucagcgaccuguacuaccucacgaugaacaacaagcacuggcuggugcacaaggagugguuccacgacaucccccugcccuggcacgccggcgccgacaccgggacgccccacuggaacaacaaggaggcgcucguggaguucaaggacgcccacgccaagcggcagaccgucguggugcugggcucccaggagggcgccguccacaccgcccuggcgggggcccucgaggccgagauggacggcgccaaggggcgccuguucagcggccaccugaagugccggcucaagauggacaagcugcgccugaaggggguguccuacagccucugcaccgccgcguucaccuucaccaaggucccggccgagacgcugcacggcaccgugaccguggagguccaguccgccggcaccgacgggcccugcaaggugcccgcccagauggccguggacaugcagacgcugacccccgucggccggcucaucaccgcgaacccggugaucaccgagagcacggagaacuccaagaugaugcuggagcuggacccgcccuucggggacagcuacaucgugaucggcgucggggacaagaagaucacccaccacuggcaccgcuccggcagcaccaucggcaaggccuucgaggccaccgugcgcggggccaagcggauggccgugcucggcgacacggcgugggacuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3567 - RNA, 1576 nt, Artificial Sequence
  KX520666.1 solE mRNA Design 1 GC
gggagaaagcuuaccaugcgccagaaggugaucuaccuggucaugauccuccugaucgcccccgccuacagcauccggugcaucggcguguccaaccgcgacuucguggaggggaugagcggcgggaccugggucgacguggugcuggagcacggcgggugcgucaccgugauggcgcaggacaagcccacgguggacaucgagcucgucaccaccaccguguccaacauggccgaggugcggagcuacugcuacgaggccuccaucagcgacauggccuccgacagccgcugccccacgcagggcgaggccuaccuggacaagcaguccgacacccaguacgucugcaagcggacccugguggaccgcggcugggggaacggcugcgggcuguucggcaaggggagccuggugaccugcgcgaaguucgccugcuccaagaagaugacgggcaagagcauccagcccgagaaccuggaguaccggaucaugcucuccguccacggcagccagcacuccgggaugaucgugaacgacaccggccacgagaccgacgagaaccgcgccaagguggagaucacccccaacagcccgcgggccgaggcgacgcucgggggcuucggcucccuggggcucgacugcgagccccgcaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcggcagaccguggucgugcuggggucccaggagggcgccgugcacaccgcccuggccggcgcccucgaggcggagauggacggggccaagggccgccugagcagcgggcaccugaagugccggcucaagauggacaagcugcgccugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgaguccaccgagaacagcaagaugaugcuggagcuggacccgcccuucggcgacuccuacaucgucaucggggugggcgagaagaagaucacccaccacuggcaccgcagcggguccacgaucggcaaggccuucgaggcgaccgugcggggcgccaagcgcauggccguccucggggacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3568 - RNA, 1576 nt, Artificial Sequence
  KF383120.1 solE mRNA Design 1 GC
gggagaaagcuuaccaugagccagcgcgugaucuaccuggucaugauccuccugaucgcccccgccuacuccauccggugcaucggcgugagcaaccgcgacuucguggaggggauguccggcgggaccugggucgacguggugcuggagcacggcgggugcgucaccgugauggcgcaggacaagcccacgguggacaucgagcucgucaccaccaccgugagcaacauggccgaggugcgguccuacugcuacgaggccagcaucuccgacauggccagcgacucccgcugccccacgcagggcgaggccuaccuggacaagcagagcgacacccaguacgucugcaagcggacccugguggaccgcggcugggggaacggcugcgggcuguucggcaaggggucccuggugaccugcgcgaaguucacgugcagcaagaagaugaccggcaaguccauccagcccgagaaccuggaguaccggaucaugcucagcguccacggcucccagcacagcgggaugaucgugaacgacaucggccacgagaccgacgagaaccgcgccaagguggaggucacccccaacuccccgcgggccgaggccacgcucgggggcuucggcagccuggggcucgacugcgagccccgcaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcggcagaccgucguggugcuggggagccaggagggcgcgguccacaccgcccuggccggcgcccucgaggccgagauggacggggcgaagggccgccuguucagcgggcaccugaagugccggaucaagauggacaagcuccgccugaagggcguguccuacagccugugcaccgccgccuucacguucuccaagguccccgccgagacccuccacgggaccgugaccguggagguccaguacgccggccgggacggccccugcaaggugcccgcgcagauggccguggacaugcagacgcugaccccggucgggcgccugaucaccgccaaccccaucaucaccgagagcacggagaacucccggaugaugcucgagcuggacccgcccuucggcgacagcuacaucgugaucggggugggcgacaagaagaucacccaccacuggcaccgcuccgggagcaccaucggcaaggccuucgaggccaccguccggggcgcgaagcgcauggccgugcugggggacacggccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3569 - RNA, 2359 nt, Artificial Sequence
  ZIKV (strain ZikaSPH2015) Polyprotein(93-804) mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3570 - RNA, 2359 nt, Artificial Sequence
  ZIKV (isolate Z1106033) Polyprotein(93-804) mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3571 - RNA, 2347 nt, Artificial Sequence
  ZIKV (strain MR 766) Polyprotein(93-800) mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3572 - RNA, 2359 nt, Artificial Sequence
  ZIKV (strain NatalRGN) Polyprotein(93-804) mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3573 - RNA, 2284 nt, Artificial Sequence
  ZIKV (strain ZikaSPH2015) Polyprotein(108-794) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3574 - RNA, 2284 nt, Artificial Sequence
  ZIKV (isolate Z1106033) Polyprotein(108-794) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3575 - RNA, 2272 nt, Artificial Sequence
  ZIKV (strain MR 766) Polyprotein(108-790) mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3576 - RNA, 2284 nt, Artificial Sequence
  ZIKV (strain NatalRGN) Polyprotein(108-794) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3577 - RNA, 1576 nt, Artificial Sequence
  ZIKV (strain ZikaSPH2015) Polyprotein(273-723) mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3578 - RNA, 1576 nt, Artificial Sequence
  ZIKV (isolate Z1106033) Polyprotein(273-723) mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3579 - RNA, 1564 nt, Artificial Sequence
  ZIKV (strain MR 766) Polyprotein(273-719) mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3580 - RNA, 1576 nt, Artificial Sequence; identical to SEQ ID NO: 3578
  ZIKV (strain NatalRGN) Polyprotein(273-723) mRNA Design 1 opt

SEQ ID NO: 3581 - RNA, 2284 nt, Artificial Sequence
  ZIKV (strain ZikaSPH2015) Polyprotein(108-794)(F398S) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3582 - RNA, 2284 nt, Artificial Sequence
  ZIKV (isolate Z1106033) Polyprotein(108-794)(F398S) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3583 - RNA, 2272 nt, Artificial Sequence
  ZIKV (strain MR 766) Polyprotein(108-790)(F398S) mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3584 - RNA, 2284 nt, Artificial Sequence
  ZIKV (strain NatalRGN) Polyprotein(108-794)(F398S) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3585 - RNA, 2284 nt, Artificial Sequence
  ZIKV (strain ZikaSPH2015) Polyprotein(108-794)(N444Q) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3586 - RNA, 2284 nt, Artificial Sequence
  ZIKV (isolate Z1106033) Polyprotein(108-794)(N444Q) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3587 - RNA, 2284 nt, Artificial Sequence
  ZIKV (strain NatalRGN) Polyprotein(108-794)(N444Q) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3588 - RNA, 2284 nt, Artificial Sequence
  ZIKV (strain ZikaSPH2015) Polyprotein(108-694)-Cterm-JAEV1-E(400-500) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3589 - RNA, 2284 nt, Artificial Sequence
  ZIKV (isolate Z1106033) Polyprotein(108-694)-Cterm-JAEV1-E(400-500) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3590 - RNA, 2272 nt, Artificial Sequence
  ZIKV (strain MR 766) Polyprotein(108-690)-Cterm-JAEV1-E(400-500) mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3591 - RNA, 2284 nt, Artificial Sequence
  ZIKV (strain NatalRGN) Polyprotein(108-694)-Cterm-JAEV1-E(400-500) mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3592 - RNA, 2359 nt, Artificial Sequence; identical to SEQ ID NO: 3569
  ZIKV (strain ZikaSPH2015) Polyprotein(93-804) mRNA Design 1 opt

SEQ ID NO: 3593 - RNA, 2356 nt, Artificial Sequence
  ZIKV prME variant mRNA Design 1 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3594 - RNA, 2353 nt, Artificial Sequence
  ZIKV prME variant mRNA Design 1 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3595 - RNA, 2350 nt, Artificial Sequence
  ZIKV prME variant mRNA Design 1 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3596 - RNA, 2347 nt, Artificial Sequence
  ZIKV prME variant mRNA Design 1 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3597 - RNA, 2344 nt, Artificial Sequence
  ZIKV prME variant mRNA Design 1 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3598 - RNA, 2341 nt, Artificial Sequence
  ZIKV prME variant mRNA Design 1 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3599 - RNA, 2338 nt, Artificial Sequence
  ZIKV prME variant mRNA Design 1 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3600 - RNA, 2335 nt, Artificial Sequence
  ZIKV prME variant mRNA Design 1 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3601 - RNA, 2332 nt, Artificial Sequence
  ZIKV prME variant mRNA Design 1 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3602 - RNA, 2329 nt, Artificial Sequence
  ZIKV prME variant mRNA Design 1 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3603 - RNA, 2326 nt, Artificial Sequence
  ZIKV prME variant mRNA Design 1 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3604 - RNA, 2323 nt, Artificial Sequence
  ZIKV prME variant mRNA Design 1 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3605 - RNA, 2320 nt, Artificial Sequence
  ZIKV prME variant mRNA Design 1 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3606 - RNA, 2317 nt, Artificial Sequence
  ZIKV prME variant mRNA Design 1 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3607 - RNA, 2314 nt, Artificial Sequence
  ZIKV prME variant mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3608 - RNA, 2314 nt, Artificial Sequence
  ZIKV prME variant mRNA Design 1 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3609 - RNA, 2326 nt, Artificial Sequence
  ZIKV prME variant mRNA Design 1 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3610 - RNA, 2350 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3611 - RNA, 2350 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3612 - RNA, 2341 nt, Artificial Sequence
  ZIKV prME variant mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3613 - RNA, 2338 nt, Artificial Sequence
  ZIKV prME variant mRNA Design 1 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3614 - RNA, 2335 nt, Artificial Sequence
  ZIKV prME variant mRNA Design 1 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3615 - RNA, 2332 nt, Artificial Sequence
  ZIKV prME variant mRNA Design 1 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3616 - RNA, 2329 nt, Artificial Sequence
  ZIKV prME variant mRNA Design 1 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3617 - RNA, 2326 nt, Artificial Sequence
  ZIKV prME variant mRNA Design 1 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3618 - RNA, 2323 nt, Artificial Sequence
  ZIKV prME variant mRNA Design 1 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3619 - RNA, 2320 nt, Artificial Sequence
  ZIKV prME variant mRNA Design 1 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3620 - RNA, 2317 nt, Artificial Sequence
  ZIKV prME variant mRNA Design 1 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3621 - RNA, 2314 nt, Artificial Sequence
  ZIKV prME variant mRNA Design 1 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3622 - RNA, 2311 nt, Artificial Sequence
  ZIKV prME variant mRNA Design 1 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3623 - RNA, 2308 nt, Artificial Sequence
  ZIKV prME variant mRNA Design 1 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3624 - RNA, 2305 nt, Artificial Sequence
  ZIKV prME variant mRNA Design 1 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3625 - RNA, 2302 nt, Artificial Sequence
  ZIKV prME variant mRNA Design 1 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3626 - RNA, 2299 nt, Artificial Sequence
  ZIKV prME variant mRNA Design 1 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3627 - RNA, 2296 nt, Artificial Sequence
  ZIKV prME variant mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3628 - RNA, 2296 nt, Artificial Sequence
  ZIKV prME variant mRNA Design 1 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3629 - RNA, 2308 nt, Artificial Sequence
  ZIKV prME variant mRNA Design 1 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3630 - RNA, 2332 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3631 - RNA, 2332 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3632 - RNA, 2332 nt, Artificial Sequence
  ZIKV prME variant mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3633 - RNA, 2329 nt, Artificial Sequence
  ZIKV prME variant mRNA Design 1 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3634 - RNA, 2326 nt, Artificial Sequence
  ZIKV prME variant mRNA Design 1 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3635 - RNA, 2323 nt, Artificial Sequence
  ZIKV prME variant mRNA Design 1 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3636 - RNA, 2320 nt, Artificial Sequence
  ZIKV prME variant mRNA Design 1 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3637 - RNA, 2317 nt, Artificial Sequence
  ZIKV prME variant mRNA Design 1 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3638 - RNA, 2314 nt, Artificial Sequence
  ZIKV prME variant mRNA Design 1 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3639 - RNA, 2311 nt, Artificial Sequence
  ZIKV prME variant mRNA Design 1 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3640 - RNA, 2308 nt, Artificial Sequence
  ZIKV prME variant mRNA Design 1 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3641 - RNA, 2305 nt, Artificial Sequence
  ZIKV prME variant mRNA Design 1 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3642 - RNA, 2302 nt, Artificial Sequence
  ZIKV prME variant mRNA Design 1 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3643 - RNA, 2299 nt, Artificial Sequence
  ZIKV prME variant mRNA Design 1 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3644 - RNA, 2296 nt, Artificial Sequence
  ZIKV prME variant mRNA Design 1 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3645 - RNA, 2293 nt, Artificial Sequence
  ZIKV prME variant mRNA Design 1 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3646 - RNA, 2290 nt, Artificial Sequence
  ZIKV prME variant mRNA Design 1 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3647 - RNA, 2287 nt, Artificial Sequence
  ZIKV prME variant mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3648 - RNA, 2287 nt, Artificial Sequence
  ZIKV prME variant mRNA Design 1 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3649 - RNA, 2299 nt, Artificial Sequence
  ZIKV prME variant mRNA Design 1 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3650 - RNA, 2323 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3651 - RNA, 2323 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3652 - RNA, 2329 nt, Artificial Sequence
  ZIKV prME variant mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3653 - RNA, 2323 nt, Artificial Sequence
  ZIKV prME variant mRNA Design 1 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3654 - RNA, 2326 nt, Artificial Sequence
  ZIKV prME variant mRNA Design 1 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3655 - RNA, 2320 nt, Artificial Sequence
  ZIKV prME variant mRNA Design 1 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3656 - RNA, 2317 nt, Artificial Sequence
  ZIKV prME variant mRNA Design 1 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3657 - RNA, 2314 nt, Artificial Sequence
  ZIKV prME variant mRNA Design 1 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3658 - RNA, 2311 nt, Artificial Sequence
  ZIKV prME variant mRNA Design 1 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3659 - RNA, 2308 nt, Artificial Sequence
  ZIKV prME variant mRNA Design 1 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3660 - RNA, 2305 nt, Artificial Sequence
  ZIKV prME variant mRNA Design 1 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3661 - RNA, 2302 nt, Artificial Sequence
  ZIKV prME variant mRNA Design 1 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3662 - RNA, 2299 nt, Artificial Sequence
  ZIKV prME variant mRNA Design 1 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3663 - RNA, 2296 nt, Artificial Sequence
  ZIKV prME variant mRNA Design 1 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3664 - RNA, 2293 nt, Artificial Sequence
  ZIKV prME variant mRNA Design 1 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3665 - RNA, 2290 nt, Artificial Sequence
  ZIKV prME variant mRNA Design 1 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3666 - RNA, 2287 nt, Artificial Sequence
  ZIKV prME variant mRNA Design 1 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3667 - RNA, 2284 nt, Artificial Sequence; identical to SEQ ID NO: 3573
  ZIKV (strain ZikaSPH2015) Polyprotein(108-794) mRNA Design 1 opt

SEQ ID NO: 3668 - RNA, 2284 nt, Artificial Sequence
  ZIKV prME variant mRNA Design 1 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3669 - RNA, 2296 nt, Artificial Sequence
  ZIKV prME variant mRNA Design 1 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3670 - RNA, 2320 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3671 - RNA, 2320 nt, Artificial Sequence
  ZIKV prME variant mRNA Design 1 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3672 - RNA, 2359 nt, Artificial Sequence; identical to SEQ ID NO: 3569
  KU321639.1 prME-long mRNA Design 1 opt

SEQ ID NO: 3673 - RNA, 2359 nt, Artificial Sequence; identical to SEQ ID NO: 3570
  KU312312.1 prME-long mRNA Design 1 opt

SEQ ID NO: 3674 - RNA, 2347 nt, Artificial Sequence; identical to SEQ ID NO: 3571
  AY632535.2 prME-long mRNA Design 1 opt

SEQ ID NO: 3675 - RNA, 2359 nt, Artificial Sequence; identical to SEQ ID NO: 3572
  KU527068.1 prME-long mRNA Design 1 opt

SEQ ID NO: 3676 - RNA, 2359 nt, Artificial Sequence
  KU720415.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3677 - RNA, 2341 nt, Artificial Sequence
  DQ859059.1 prME-long mRNA Design 1 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3678 - RNA, 2359 nt, Artificial Sequence
  KX377335.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3679 - RNA, 2359 nt, Artificial Sequence
  LC002520.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3680 - RNA, 2347 nt, Artificial Sequence
  KU963573.2 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3681 - RNA, 2359 nt, Artificial Sequence
  KX694534.2 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3682 - RNA, 2359 nt, Artificial Sequence
  KX447520.1 prME-long mRNA Design 1 opt
gggagaaagcuuaccaugcgcaucaucaacgcccgcaaggagaagaagcgccgcggcgccgacgccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3683 - RNA, 2359 nt, Artificial Sequence
  KX369547.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3684 - RNA, 2359 nt, Artificial Sequence
  KX447515.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3685 - RNA, 2359 nt, Artificial Sequence
  KU501217.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3686 - RNA, 2359 nt, Artificial Sequence
  KU312314.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3687 - RNA, 2359 nt, Artificial Sequence
  KX446950.2 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3688 - RNA, 2359 nt, Artificial Sequence
  KY003157.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3689 - RNA, 2359 nt, Artificial Sequence
  KX811222.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3690 - RNA, 2359 nt, Artificial Sequence
  KX447516.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3691 - RNA, 2359 nt, Artificial Sequence
  KX520666.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3692 - RNA, 2359 nt, Artificial Sequence
  KU729218.1 prME-long mRNA Design 1 opt
gggagaaagcuuaccaugcgcaucaucaacgcccgcaaggagaagaagcgccgcuccgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3693 - RNA, 2359 nt, Artificial Sequence
  KU761561.1 prME-long mRNA Design 1 opt
gggagaaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3694 - RNA, 2359 nt, Artificial Sequence
  KY317938.1 prME-long mRNA Design 1 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3695 - RNA, 2359 nt, Artificial Sequence
  KY075939.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3696 - RNA, 2359 nt, Artificial Sequence
  KX806557.2 prME-long mRNA Design 1 opt
gggagaaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3697 - RNA, 2359 nt, Artificial Sequence
  KU870645.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3698 - RNA, 2359 nt, Artificial Sequence
  KU729217.2 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3699 - RNA, 2359 nt, Artificial Sequence
  KU497555.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3700 - RNA, 2359 nt, Artificial Sequence
  KX087101.3 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3701 - RNA, 2359 nt, Artificial Sequence
  KY075932.1 prME-long mRNA Design 1 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3702 - RNA, 2359 nt, Artificial Sequence
  KY014317.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3703 - RNA, 2359 nt, Artificial Sequence
  KU758876.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3704 - RNA, 2359 nt, Artificial Sequence
  KU758874.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3705 - RNA, 2359 nt, Artificial Sequence
  KY014314.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3706 - RNA, 2359 nt, Artificial Sequence
  KU926310.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3707 - RNA, 2359 nt, Artificial Sequence
  KU761560.1 prME-long mRNA Design 1 opt
gggagaaagcuuaccaugcgcaucaucaacgccggcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3708 - RNA, 2359 nt, Artificial Sequence
  KY317939.1 prME-long mRNA Design 1 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3709 - RNA, 2359 nt, Artificial Sequence
  KY075937.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3710 - RNA, 2359 nt, Artificial Sequence
  LC191864.1 prME-long mRNA Design 1 opt
gggagaaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3711 - RNA, 2359 nt, Artificial Sequence
  KX447517.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3712 - RNA, 2359 nt, Artificial Sequence
  KU922923.1 prME-long mRNA Design 1 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3713 - RNA, 2359 nt, Artificial Sequence
  KY003156.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3714 - RNA, 2359 nt, Artificial Sequence
  KU312313.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3715 - RNA, 2359 nt, Artificial Sequence
  KY075935.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3716 - RNA, 2359 nt, Artificial Sequence
  KY014320.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3717 - RNA, 2359 nt, Artificial Sequence
  KX827309.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3718 - RNA, 2359 nt, Artificial Sequence
  KU681081.3 prME-long mRNA Design 1 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3719 - RNA, 2359 nt, Artificial Sequence
  KU744693.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcggcgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3720 - RNA, 2359 nt, Artificial Sequence
  KY328290.1 prME-long mRNA Design 1 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3721 - RNA, 2359 nt, Artificial Sequence
  KX694532.2 prME-long mRNA Design 1 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3722 - RNA, 2359 nt, Artificial Sequence
  KU955593.1 prME-long mRNA Design 1 opt
gggagaaagcuuaccaugcgcaucaucaacgcccgcaaggagaagaagcgccgcggcaccgacaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3723 - RNA, 2359 nt, Artificial Sequence
  KY272987.1 prME-long mRNA Design 1 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3724 - RNA, 2359 nt, Artificial Sequence
  EU545988.1 prME-long mRNA Design 1 opt
gggagaaagcuuaccaugcgcaucaucaacgcccgcaaggagaagaagcgccgcggcaccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3725 - RNA, 2359 nt, Artificial Sequence
  KU681082.3 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3726 - RNA, 2359 nt, Artificial Sequence
  KX601167.1 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3727 - RNA, 2359 nt, Artificial Sequence
  KX694533.2 prME-long mRNA Design 1 opt
gggagaaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3728 - RNA, 2359 nt, Artificial Sequence
  KY288905.1 prME-long mRNA Design 1 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3729 - RNA, 2359 nt, Artificial Sequence
  KF268950.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3730 - RNA, 2359 nt, Artificial Sequence
  KF383121.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3731 - RNA, 2341 nt, Artificial Sequence
  KF268949.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3732 - RNA, 2359 nt, Artificial Sequence
  KU955595.1 prME-long mRNA Design 1 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3733 - RNA, 2359 nt, Artificial Sequence
  KF383116.1 prME-long mRNA Design 1 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3734 - RNA, 2341 nt, Artificial Sequence
  KU963574.2 prME-long mRNA Design 1 opt
gggagaaagcuuaccaugcgcaucaucaacgcccgcaaggagcgcaagcgccgcggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3735 - RNA, 2341 nt, Artificial Sequence
  KX601166.1 prME-long mRNA Design 1 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3736 - RNA, 2359 nt, Artificial Sequence
  KF383118.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3737 - RNA, 2353 nt, Artificial Sequence
  KF383120.1 prME-long mRNA Design 1 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccgacgucggcugcuccgucgacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3738 - RNA, 2284 nt, Artificial Sequence; identical to SEQ ID NO: 3573
  KU321639.1 prME-short mRNA Design 1 opt

SEQ ID NO: 3739 - RNA, 2284 nt, Artificial Sequence; identical to SEQ ID NO: 3574
  KU312312.1 prME-short mRNA Design 1 opt

SEQ ID NO: 3740 - RNA, 2272 nt, Artificial Sequence; identical to SEQ ID NO: 3575
  AY632535.2 prME-short mRNA Design 1 opt

SEQ ID NO: 3741 - RNA, 2284 nt, Artificial Sequence; identical to SEQ ID NO: 3576
  KU527068.1 prME-short mRNA Design 1 opt

SEQ ID NO: 3742 - RNA, 2284 nt, Artificial Sequence
  KX421193.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3743 - RNA, 2284 nt, Artificial Sequence
  KX377335.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3744 - RNA, 2284 nt, Artificial Sequence
  LC002520.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3745 - RNA, 2266 nt, Artificial Sequence
  DQ859059.1 prME-short mRNA Design 1 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3746 - RNA, 2272 nt, Artificial Sequence
  KU963573.2 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3747 - RNA, 2284 nt, Artificial Sequence
  KX694534.2 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3748 - RNA, 2284 nt, Artificial Sequence
  KX369547.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3749 - RNA, 2284 nt, Artificial Sequence
  KX447515.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3750 - RNA, 2284 nt, Artificial Sequence
  KU729218.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3751 - RNA, 2284 nt, Artificial Sequence
  KU501217.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3752 - RNA, 2284 nt, Artificial Sequence
  KU312314.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3753 - RNA, 2284 nt, Artificial Sequence
  KX446950.2 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3754 - RNA, 2284 nt, Artificial Sequence
  KY003157.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3755 - RNA, 2284 nt, Artificial Sequence
  KX811222.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3756 - RNA, 2284 nt, Artificial Sequence
  KX447516.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3757 - RNA, 2284 nt, Artificial Sequence
  KX520666.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3758 - RNA, 2284 nt, Artificial Sequence
  KU497555.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3759 - RNA, 2284 nt, Artificial Sequence
  KY075939.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3760 - RNA, 2284 nt, Artificial Sequence
  KY075932.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3761 - RNA, 2284 nt, Artificial Sequence
  KU870645.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3762 - RNA, 2284 nt, Artificial Sequence
  KU729217.2 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3763 - RNA, 2284 nt, Artificial Sequence
  KX087101.3 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3764 - RNA, 2284 nt, Artificial Sequence
  KY014317.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3765 - RNA, 2284 nt, Artificial Sequence
  KU758876.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3766 - RNA, 2284 nt, Artificial Sequence
  KU758874.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3767 - RNA, 2284 nt, Artificial Sequence
  KY317939.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3768 - RNA, 2284 nt, Artificial Sequence
  KY014314.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3769 - RNA, 2284 nt, Artificial Sequence
  KX447517.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3770 - RNA, 2284 nt, Artificial Sequence
  KU926310.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3771 - RNA, 2284 nt, Artificial Sequence
  KU922923.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3772 - RNA, 2284 nt, Artificial Sequence
  KY075937.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3773 - RNA, 2284 nt, Artificial Sequence
  KY003156.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3774 - RNA, 2284 nt, Artificial Sequence
  KU312313.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3775 - RNA, 2284 nt, Artificial Sequence
  KY075935.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3776 - RNA, 2284 nt, Artificial Sequence
  KY014320.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3777 - RNA, 2284 nt, Artificial Sequence
  KY328290.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3778 - RNA, 2284 nt, Artificial Sequence
  KU681081.3 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3779 - RNA, 2284 nt, Artificial Sequence
  KX827309.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3780 - RNA, 2284 nt, Artificial Sequence
  KU955593.1 prME-short mRNA Design 1 opt
gggagaaagcuuaccaugaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3781 - RNA, 2284 nt, Artificial Sequence
  KY272987.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3782 - RNA, 2284 nt, Artificial Sequence
  KY007221.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3783 - RNA, 2284 nt, Artificial Sequence
  EU545988.1 prME-short mRNA Design 1 opt
gggagaaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3784 - RNA, 2284 nt, Artificial Sequence
  KU681082.3 prME-short mRNA Design 1 opt
gggagaaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3785 - RNA, 2284 nt, Artificial Sequence
  KX601167.1 prME-short mRNA Design 1 opt
gggagaaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3786 - RNA, 2284 nt, Artificial Sequence
  KX694533.2 prME-short mRNA Design 1 opt
gggagaaagcuuaccaugaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3787 - RNA, 2284 nt, Artificial Sequence
  KY288905.1 prME-short mRNA Design 1 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3788 - RNA, 2284 nt, Artificial Sequence
  KF268950.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3789 - RNA, 2284 nt, Artificial Sequence
  KF383121.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3790 - RNA, 2266 nt, Artificial Sequence
  KF268949.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3791 - RNA, 2284 nt, Artificial Sequence
  KU955595.1 prME-short mRNA Design 1 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3792 - RNA, 2284 nt, Artificial Sequence
  KF383116.1 prME-short mRNA Design 1 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3793 - RNA, 2266 nt, Artificial Sequence
  KX601166.1 prME-short mRNA Design 1 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3794 - RNA, 2284 nt, Artificial Sequence
  KF383118.1 prME-short mRNA Design 1 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3795 - RNA, 2281 nt, Artificial Sequence
  KX447520.1 prME-short mRNA Design 1 opt
gggagaaagcuuaccauguccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3796 - RNA, 2284 nt, Artificial Sequence
  KU761561.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3797 - RNA, 2284 nt, Artificial Sequence
  KX806557.2 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3798 - RNA, 2284 nt, Artificial Sequence
  LC191864.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3799 - RNA, 2284 nt, Artificial Sequence
  KU744693.1 prME-short mRNA Design 1 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3800 - RNA, 2275 nt, Artificial Sequence
  KU963574.2 prME-short mRNA Design 1 opt
gggagaaagcuuaccaugggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3801 - RNA, 2293 nt, Artificial Sequence
  KF383120.1 prME-short mRNA Design 1 opt
gggagaaagcuuaccaugggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3802 - RNA, 1576 nt, Artificial Sequence; identical to SEQ ID NO: 3577
  KU321639.1 solE mRNA Design 1 opt

SEQ ID NO: 3803 - RNA, 1576 nt, Artificial Sequence; identical to SEQ ID NO: 3578
  KU312312.1 solE mRNA Design 1 opt

SEQ ID NO: 3804 - RNA, 1564 nt, Artificial Sequence; identical to SEQ ID NO: 3579
  AY632535.2 solE mRNA Design 1 opt

SEQ ID NO: 3805 - RNA, 1576 nt, Artificial Sequence; identical to SEQ ID NO: 3578
  KU527068.1 solE mRNA Design 1 opt

SEQ ID NO: 3806 - RNA, 1576 nt, Artificial Sequence
  KX421193.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3807 - RNA, 1576 nt, Artificial Sequence
  LC002520.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3808 - RNA, 1558 nt, Artificial Sequence
  DQ859059.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3809 - RNA, 1564 nt, Artificial Sequence
  KU963573.2 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3810 - RNA, 1576 nt, Artificial Sequence
  KY075939.1 solE mRNA Design 1 opt
gggagaaagcuuaccaugucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3811 - RNA, 1576 nt, Artificial Sequence
  KX447516.1 solE mRNA Design 1 opt
gggagaaagcuuaccauguccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3812 - RNA, 1576 nt, Artificial Sequence
  KX447515.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3813 - RNA, 1576 nt, Artificial Sequence
  KU758874.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3814 - RNA, 1576 nt, Artificial Sequence
  KU729218.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3815 - RNA, 1576 nt, Artificial Sequence
  KU501217.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3816 - RNA, 1576 nt, Artificial Sequence
  KU761561.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3817 - RNA, 1576 nt, Artificial Sequence
  KY075937.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3818 - RNA, 1576 nt, Artificial Sequence
  KY014317.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3819 - RNA, 1576 nt, Artificial Sequence
  KU870645.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3820 - RNA, 1576 nt, Artificial Sequence
  KU922923.1 solE mRNA Design 1 opt
gggagaaagcuuaccaugucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3821 - RNA, 1576 nt, Artificial Sequence
  KU497555.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3822 - RNA, 1576 nt, Artificial Sequence
  KU312314.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3823 - RNA, 1576 nt, Artificial Sequence
  KY014314.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3824 - RNA, 1576 nt, Artificial Sequence
  KX447517.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3825 - RNA, 1576 nt, Artificial Sequence
  KU729217.2 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3826 - RNA, 1576 nt, Artificial Sequence
  KY328290.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3827 - RNA, 1576 nt, Artificial Sequence
  KX087101.3 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3828 - RNA, 1576 nt, Artificial Sequence
  KY003156.1 solE mRNA Design 1 opt
gggagaaagcuuaccaugucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3829 - RNA, 1576 nt, Artificial Sequence
  KU758876.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3830 - RNA, 1576 nt, Artificial Sequence
  KU926310.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3831 - RNA, 1576 nt, Artificial Sequence
  KU681081.3 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3832 - RNA, 1576 nt, Artificial Sequence
  KU744693.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3833 - RNA, 1576 nt, Artificial Sequence
  EU545988.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3834 - RNA, 1576 nt, Artificial Sequence
  KY007221.1 solE mRNA Design 1 opt
gggagaaagcuuaccaugucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3835 - RNA, 1576 nt, Artificial Sequence
  KY003152.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcgccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3836 - RNA, 1576 nt, Artificial Sequence
  KX694533.2 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3837 - RNA, 1576 nt, Artificial Sequence
  KX601167.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3838 - RNA, 1576 nt, Artificial Sequence
  KY288905.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3839 - RNA, 1576 nt, Artificial Sequence
  KF268950.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3840 - RNA, 1576 nt, Artificial Sequence
  KF383116.1 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3841 - RNA, 1558 nt, Artificial Sequence
  KU963574.2 solE mRNA Design 1 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3842 - RNA, 1576 nt, Artificial Sequence
  KF383118.1 solE mRNA Design 1 opt
gggagaaagcuuaccaugucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3843 - RNA, 1576 nt, Artificial Sequence
  KX520666.1 solE mRNA Design 1 opt
gggagaaagcuuaccaugcgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3844 - RNA, 1576 nt, Artificial Sequence
  KF383120.1 solE mRNA Design 1 opt
gggagaaagcuuaccaugucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3845 - RNA, 2359 nt, Artificial Sequence
  ZIKV (strain ZikaSPH2015) Polyprotein(93-804) mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3846 - RNA, 2359 nt, Artificial Sequence
  ZIKV (isolate Z1106033) Polyprotein(93-804) mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaaugcaaagaacgguagcauauccuugaugugucucgccuuagggggaguucugaucuuccugucaacggcugucagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3847 - RNA, 2347 nt, Artificial Sequence
  ZIKV (strain MR 766) Polyprotein(93-800) mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugaggaccgagcaaaggucgaggugacaccuaauucaccacgcgcugaagccacucuugggggauucggcagucuggguuuggauugugagcccagaaccgggcucgacuuuagcgaucuguauuacuuaacaaugaacaauaaacacuggcugguacauaaggaaugguuccacgacauaccucucccauggcacgcuggcgccgauacuggaaccccgcauuggaacaauaaagaggcacuuguugaauuuaaggacgcccacgcuaagaggcagacaguggucgugcugggcucccaggagggggcgguccauaccgcauuggccggagcucuagaggccgaaauggauggugcaaaaggccggcuguucucugggcaccucaagugccgccugaaaauggacaaacuuagacugaagggagugagcuauucauuguguacugccgcuuuuacguucacaaagguucccgccgagacccuccauggcacugugaccguagaaguccaguacgcagguacagacgggccuugcaagaucccagugcaaauggcgguugauaugcagacccugacucccgugggcagguuaauuacagcuaacccugucaucacggagaguaccgaaaauuccaaaaugaugcuggagcuagacccacccuuuggagauagcuacauagugauuggcguaggggacaagaaaaucacucaccacuggcaucguucuggaucaacaaucgguaaggccuucgaggcaaccgugcggggcgccaaacgaauggcuguucucggggauacagccugggacuucggaagugucggcgguguguuuaacagccuggggaagggcauucaccagaucuucggagcagcuuuuaagucccuuuucggcgggaugucuugguuuucgcaaauuuugauaggaacucugcucguguggcugggccuuaacaccaaaaaugguagcaucucccugacguguuuggcccucgggggagucaugauuuuccugucaaccgcgguuagugccgaugugggcugcucuguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3848 - RNA, 2359 nt, Artificial Sequence
  ZIKV (strain NatalRGN) Polyprotein(93-804) mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3849 - RNA, 2284 nt, Artificial Sequence
  ZIKV (strain ZikaSPH2015) Polyprotein(108-794) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3850 - RNA, 2284 nt, Artificial Sequence
  ZIKV (isolate Z1106033) Polyprotein(108-794) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacgccaagaauggcagcaucuccuugaugugucucgcucugggugggguuuuaauuuuccugucaacggcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3851 - RNA, 2272 nt, Artificial Sequence
  ZIKV (strain MR 766) Polyprotein(108-790) mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacaauuggaaaggcguucgaggcuaccgugcggggugccaaacgcauggcaguucucggcgacacagccugggauuucgggagugucggaggcguguuuaauagccuggguaaggggauccaccagaucuucggcgcugccuuuaaaucccuuuucggaggcaugucuugguuuucgcaaauuuugaucgggacucugcucguguggcugggacuuaacaccaagaacggcagcauuucccugacguguuuggcacucgguggggucaugauauuccugucaaccgcuguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3852 - RNA, 2284 nt, Artificial Sequence
  ZIKV (strain NatalRGN) Polyprotein(108-794) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3853 - RNA, 1576 nt, Artificial Sequence
  ZIKV (strain ZikaSPH2015) Polyprotein(273-723) mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagauaucgugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3854 - RNA, 1576 nt, Artificial Sequence
  ZIKV (isolate Z1106033) Polyprotein(273-723) mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgaaacggauggcaguucugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3855 - RNA, 1564 nt, Artificial Sequence
  ZIKV (strain MR 766) Polyprotein(273-719) mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugaggacagggccaagguggaagucacgcccaacaguccucgggcugaggcaacucugggaggguuuggcagcuugggucucgauugcgagccacgcaccgggcuggacuucucugaucuguacuaccucacaaugaauaacaaacauugguuaguucacaaggaaugguuucaugacauuccccugccuuggcacgccggagcugacacuggcaccccacacuggaauaacaaagaggcccuuguggaguucaaggaugcgcaugcaaagagacagacaguaguggucuugggcucccaggaaggggccgugcacaccgcucuggccggagcacuagaagcugagauggacggugccaaaggcaggcucuuuucagggcaucugaagugucggcuuaaaauggauaagcugcgcuugaaaggaguuagcuauagucucugcacggcggccuucacuuuuacaaaggugcccgcagagacccugcacggcacugucacaguggaaguacaauacgcugguaccgacgggccuuguaaaaucccaguucagauggccguggauaugcagacguuaaccccggucggccgacugauuacagcuaaucccgugaucacugagucuaccgaaaacuccaagaugaugcucgagcuugacccuccauucggagauagcuauauagucauuggcgugggggacaagaaaaucacacaccauuggcacagaucgggaucuacuauugguaaggccuuugaagcaaccguuaggggcgccaaacggauggcugugcugggggauacagcgugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3856 - RNA, 1576 nt, Artificial Sequence; identical to SEQ ID NO: 3854
  ZIKV (strain NatalRGN) Polyprotein(273-723) mRNA Design 1 opt

SEQ ID NO: 3857 - RNA, 2284 nt, Artificial Sequence
  ZIKV (strain ZikaSPH2015) Polyprotein(108-794)(F398S) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcugaguggaaagggcucucuagucacaugcgcgaaauucgccugcuccaagaaaaugaccggcaagagcauucagccugaaaaccucgaguaccguaucaugcugucggugcacgggucucaacacuccggaaugauuguuaaugacacgggucaugaaaccgaugagaaccgcgcaaagguggagaucacaccaaauucacccagagcugaagccacucuuggcggguuuggaagucugggcuuggacugugagccuaggaccggucucgauuucagcgaccuguauuacuuaacaaugaacaauaaacacuggcugguccauaaggaaugguuucacgauaucccacucccguggcacgcuggggccgacacuggcaccccucauuggaacaauaaagaggcacuuguggaguucaaggaugcccacgcuaaacggcagacaguaguugugcugggaucccaggaaggcgcgguccauaccgcauuggccggggcucuagaggccgaaauggacggagcaaagggucgacugucuagcggccaccucaaaugccgccugaagauggauaagcugagacugaaaggggugucauauaguuuguguacugccgcuuuuacguucacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggaguccaccgaaaacagcaagaugaugcuggagcuagaucccccguuuggcgacucuuacauuguuaucggagugggcgagaaaaagauaacucaccacuggcaucggucagggaguacaauuggaaaggcauucgaagccaccguccgcggugcuaaaagaauggccgugcucggcgauacagcaugggacuuugggagcguaggaggcgcucuuaauucccuugguaaggggauccaccagaucuucggcgccgcguucaaaucuuuguuuggaggcaugucgugguucagccaaauucugaucgggacucuccugauguggcuuggacugaacaccaagaauggcuccauuucauugaugugucucgcccugggugggguguuaauauuucugaguacggcuguuucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3858 - RNA, 2284 nt, Artificial Sequence
  ZIKV (isolate Z1106033) Polyprotein(108-794)(F398S) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcugaguggaaagggcucucuagugaccugcgcgaaauucgccugcuccaagaaaaugacgggcaagagcauacagccugaaaaccucgaguaccguauuaugcugucgguucacgggucucaacacuccggaaugaucgugaaugacaccggucaugaaacagaugagaaccgcgcaaaggucgagauuacuccaaauucacccagagcugaagccacccuuggcggguuuggaagucugggcuuggacugugagccuaggacaggucucgauuucagcgaccuguauuacuuaacuaugaacaauaaacacuggcuggugcauaaggaaugguuucacgauaucccacucccguggcacgcuggggccgacaccggcacaccccauuggaacaauaaagaggcacuuguagaguucaaggaugcccacgcuaaacggcagaccguugugguccugggaucccaggaaggcgcggugcauacugcauuggccggggcucuagaggccgaaauggacggagcaaagggucgacugucuagcggccaccucaaaugccgccugaagauggauaagcugagacugaaaggggucucauauaguuuguguacggccgcuuuuacauucaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgaguccacugaaaacagcaagaugaugcuggagcuagaucccccguuuggcgacucuuacaucgugauuggagucggcgagaaaaagaucacacaccacuggcaucggucagggaguaccauaggaaaggcauucgaagccacagugcgcggugcuaaaagaauggccguacucggcgauacugcaugggacuuugggagcgugggaggcgcucuuaauucccuugguaaggggauucaccagaucuucggcgccgcguucaaaucuuuguuuggaggcaugucgugguucagccaaauccugauugggacccuccugauguggcuuggacugaacgccaagaauggcuccaucucauugaugugucucgcucugggugggguuuuaauuuuucugaguacggcagucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3859 - RNA, 2272 nt, Artificial Sequence
  ZIKV (strain MR 766) Polyprotein(108-790)(F398S) mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcugucuggaaagggcucccuaguuacaugcgccaaauuuaccugcagcaagaagaugacgggcaaaucgauccagcccgaaaaucucgaauaucggauuaugcugucugugcacgggucccaacauucaggaaugaucgguuacgagaccgacgaagaucgugcgaaggucgaggugacaccuaacaguccacgcgccgaggcaacucuuggcggguucggaagccugggcuuggacugugaacccagaaccggucucgauuucuccgaccuguauuacuuaacaaugaauaacaaacacuggcugguacauaaggagugguuucacgauaucccucucccauggcacgcuggggccgacacuggcaccccgcauuggaauaacaaagaagcucuuguugaguucaaggaugcccacgcaaaaaggcagacaguggucgugcugggaucucaggaaggcgccguccauaccgcuuuggcgggggcacuagaggccgagauggacggagcuaagggucggcuguuuagcggccaccucaagugccgacugaaaauggauaaacuucgccugaagggggugucauauaguuuguguacugccgcauucacguuuacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaauccaccgagaacagcaagaugaugcuggaacuagauccacccuucggcgacucuuacauugugaucggaguaggcgauaagaaaauaacucaccacuggcauaggucagggaguacaauuggaaaggcguuugaggcuaccgugcggggugccaaacgcauggcaguucucggcgacacagccugggauuucgggagcgucggaggcguguucaauucccuggguaaggggauccaccagaucuuuggcgcugccuucaaaucucuuuuuggaggcaugucgugguucagccaaauuuugaucgggacucugcucguguggcugggacuuaacaccaagaacggcuccauuucacugacguguuuggcacucgguggggucaugauauuucugaguaccgcuguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3860 - RNA, 2284 nt, Artificial Sequence
  ZIKV (strain NatalRGN) Polyprotein(108-794)(F398S) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcugaguggaaagggcucucuagugacaugcgcgaaauucgccugcuccaagaaaaugaccggcaagagcauacagccugaaaaccucgaguaccguauuaugcugucgguucacgggucucaacacuccggaaugaucgugaaugacacgggucaugaaaccgaugagaaccgcgcaaaggucgagauuacaccaaauucacccagagcugaagccacucuuggcggguuuggaagucugggcuuggacugugagccuaggaccggucucgauuucagcgaccuguauuacuuaacaaugaacaauaaacacuggcuggugcauaaggaaugguuucacgauaucccacucccguggcacgcuggggccgacacuggcaccccucauuggaacaauaaagaggcacuuguagaguucaaggaugcccacgcuaaacggcagacaguugugguccugggaucccaggaaggcgcggugcauaccgcauuggccggggcucuagaggccgaaauggacggagcaaagggucgacugucuagcggccaccucaaaugccgccugaagauggauaagcugagacugaaaggggucucauauaguuuguguacugccgcuuuuacguucacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggaguccaccgaaaacagcaagaugaugcuggagcuagaucccccguuuggcgacucuuacaucgugauuggagucggcgagaaaaagaucacucaccacuggcaucggucagggaguacaauaggaaaggcauucgaagccaccgugcgcggugcuaaaagaauggccguacucggcgauacagcaugggacuuugggagcgugggaggcgcucuuaauucccuugguaaggggauucaccagaucuucggcgccgcguucaaaucuuuguuuggaggcaugucgugguucagccaaauccugauugggacucuccugauguggcuuggacugaacaccaagaauggcuccaucucauugaugugucucgcccugggugggguuuuaauuuuucugaguacggcugucucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3861 - RNA, 2284 nt, Artificial Sequence
  ZIKV (strain ZikaSPH2015) Polyprotein(108-794)(N444Q) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguucaggacacgggucaugaaaccgaugagaaucgcgcaaagguggagaucacaccaaacucccccagagcugaagccacucuuggcggguucggaucacugggcuuggacugugagccuaggaccggucucgauuuuagugaccuguauuacuuaacaaugaauaacaaacacuggcugguccauaaggaaugguuccacgauaucccacucccguggcacgcuggggccgacacuggcaccccucauuggaauaacaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaauacgcaggcacagacgguccaugcaaagugcccgcgcagauggcuguagacaugcagacccugacuccugucgggagguuaauaacagccaauccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaacagccuugguaaggggauccaccaaaucuucggcgccgcguuuaaauccuuguucggaggcaugucuugguuuucgcagauucugaucgggacucuccugauguggcuuggacugaauaccaagaacggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3862 - RNA, 2284 nt, Artificial Sequence
  ZIKV (isolate Z1106033) Polyprotein(108-794)(N444Q) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugcaggacaccggucaugaaacagaugagaaucgcgcaaaggucgagauuacuccaaacucccccagagcugaagccacccuuggcggguucggaucacugggcuuggacugugagccuaggacaggucucgauuuuagugaccuguauuacuuaacuaugaauaacaaacacuggcuggugcauaaggaaugguuccacgauaucccacucccguggcacgcuggggccgacaccggcacaccccauuggaauaacaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaauacgcaggcaccgacgguccaugcaaaguacccgcgcagauggcugucgacaugcagacucugacaccuguggggagguuaauuacggccaauccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaacagccuugguaaggggauucaccaaaucuucggcgccgcguuuaaauccuuguucggaggcaugucuugguuuucgcagauccugauugggacccuccugauguggcuuggacugaaugccaagaacggcagcaucuccuugaugugucucgcucugggugggguuuuaauuuuccugucaacggcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3863 - RNA, 2284 nt, Artificial Sequence
  ZIKV (strain NatalRGN) Polyprotein(108-794)(N444Q) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugcaggacacgggucaugaaaccgaugagaaucgcgcaaaggucgagauuacaccaaacucccccagagcugaagccacucuuggcggguucggaucacugggcuuggacugugagccuaggaccggucucgauuuuagugaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagguuaauuacagccaauccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaacagccuugguaaggggauucaccaaaucuucggcgccgcguuuaaauccuuguucggaggcaugucuugguuuucgcagauccugauugggacucuccugauguggcuuggacugaauaccaagaacggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3864 - RNA, 2284 nt, Artificial Sequence
  ZIKV (strain ZikaSPH2015) Polyprotein(108-694)-Cterm-JAEV1-E(400-500) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacacucggaaaggcauuuaguaccacacugaaaggugcccagcgccuugcugccuugggcgauacugcaugggacuucgggagcauuggaggcgucuucaauuccaucgguagagcugugcaccaaguauuugggggcgccuucaggacccuguuuggaggcaugucuuggaucacgcaggggcucaugggagcgcugcuucuguggaugggcgugaacgcccgugaucggucgauugcuuuggcauuccucgccaccggugggguucuggucuuuuuagcuacaaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3865 - RNA, 2284 nt, Artificial Sequence
  ZIKV (isolate Z1106033) Polyprotein(108-694)-Cterm-JAEV1-E(400-500) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaacccucggaaaggcauuuaguacaacucugaaaggugcccagcgccuugcugccuugggcgauaccgcaugggacuucgggagcauaggaggcguguucaauuccauugguagagcuguacaccaaguguuugggggcgccuucaggacgcuguuuggaggcaugucuuggaucacccaggggcucaugggagcgcugcuucuguggaugggcguuaacgcccgugaucggucgaucgcuuuggcauuccucgccacaggugggguccugguguuuuuagcuacuaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3866 - RNA, 2272 nt, Artificial Sequence
  ZIKV (strain MR 766) Polyprotein(108-690)-Cterm-JAEV1-E(400-500) mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacacucggaaaggcguucaguaccacacugaaaggugcucagcggcuugccgcauugggcgacacugccugggauuucgggagcauuggaggcguguuuaauuccaucggucgcgcuguucaccaagucuucgggggcgccuuuagaacccuguucggaggcaugucuuggaucacgcaggggcucaugggagcacugcuucuguggaugggcgugaacgcuagggaccguucgauugccuuggcguuucucgccaccgguggggugcuggucuucuuagcuacaaacguucaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3867 - RNA, 2284 nt, Artificial Sequence
  ZIKV (strain NatalRGN) Polyprotein(108-694)-Cterm-JAEV1-E(400-500) mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacacucggaaaggcauuuaguaccacacugaaaggugcccagcgccuugcugccuugggcgauacugcaugggacuucgggagcauaggaggcguguucaauuccauugguagagcuguacaccaaguguuugggggcgccuucaggacccuguuuggaggcaugucuuggaucacgcaggggcucaugggagcgcugcuucuguggaugggcguuaacgcccgugaucggucgaucgcuuuggcauuccucgccaccggugggguccugguguuuuuagcuacaaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3868 - RNA, 2359 nt, Artificial Sequence; identical to SEQ ID NO: 3845
  ZIKV (strain ZikaSPH2015) Polyprotein(93-804) mRNA Design 1 opt

SEQ ID NO: 3869 - RNA, 2356 nt, Artificial Sequence
  ZIKV prME variant mRNA Design 1 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3870 - RNA, 2353 nt, Artificial Sequence
  ZIKV prME variant mRNA Design 1 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3871 - RNA, 2350 nt, Artificial Sequence
  ZIKV prME variant mRNA Design 1 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3872 - RNA, 2347 nt, Artificial Sequence
  ZIKV prME variant mRNA Design 1 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3873 - RNA, 2344 nt, Artificial Sequence
  ZIKV prME variant mRNA Design 1 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3874 - RNA, 2341 nt, Artificial Sequence
  ZIKV prME variant mRNA Design 1 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3875 - RNA, 2338 nt, Artificial Sequence
  ZIKV prME variant mRNA Design 1 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3876 - RNA, 2335 nt, Artificial Sequence
  ZIKV prME variant mRNA Design 1 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3877 - RNA, 2332 nt, Artificial Sequence
  ZIKV prME variant mRNA Design 1 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3878 - RNA, 2329 nt, Artificial Sequence
  ZIKV prME variant mRNA Design 1 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3879 - RNA, 2326 nt, Artificial Sequence
  ZIKV prME variant mRNA Design 1 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3880 - RNA, 2323 nt, Artificial Sequence
  ZIKV prME variant mRNA Design 1 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3881 - RNA, 2320 nt, Artificial Sequence
  ZIKV prME variant mRNA Design 1 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3882 - RNA, 2317 nt, Artificial Sequence
  ZIKV prME variant mRNA Design 1 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3883 - RNA, 2314 nt, Artificial Sequence
  ZIKV prME variant mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcucuguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3884 - RNA, 2314 nt, Artificial Sequence
  ZIKV prME variant mRNA Design 1 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcucuguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3885 - RNA, 2326 nt, Artificial Sequence
  ZIKV prME variant mRNA Design 1 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3886 - RNA, 2350 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcuccguggauuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3887 - RNA, 2350 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcuccguggauuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3888 - RNA, 2341 nt, Artificial Sequence
  ZIKV prME variant mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3889 - RNA, 2338 nt, Artificial Sequence
  ZIKV prME variant mRNA Design 1 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3890 - RNA, 2335 nt, Artificial Sequence
  ZIKV prME variant mRNA Design 1 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3891 - RNA, 2332 nt, Artificial Sequence
  ZIKV prME variant mRNA Design 1 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3892 - RNA, 2329 nt, Artificial Sequence
  ZIKV prME variant mRNA Design 1 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3893 - RNA, 2326 nt, Artificial Sequence
  ZIKV prME variant mRNA Design 1 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3894 - RNA, 2323 nt, Artificial Sequence
  ZIKV prME variant mRNA Design 1 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3895 - RNA, 2320 nt, Artificial Sequence
  ZIKV prME variant mRNA Design 1 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3896 - RNA, 2317 nt, Artificial Sequence
  ZIKV prME variant mRNA Design 1 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3897 - RNA, 2314 nt, Artificial Sequence
  ZIKV prME variant mRNA Design 1 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3898 - RNA, 2311 nt, Artificial Sequence
  ZIKV prME variant mRNA Design 1 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3899 - RNA, 2308 nt, Artificial Sequence
  ZIKV prME variant mRNA Design 1 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3900 - RNA, 2305 nt, Artificial Sequence
  ZIKV prME variant mRNA Design 1 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3901 - RNA, 2302 nt, Artificial Sequence
  ZIKV prME variant mRNA Design 1 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3902 - RNA, 2299 nt, Artificial Sequence
  ZIKV prME variant mRNA Design 1 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3903 - RNA, 2296 nt, Artificial Sequence
  ZIKV prME variant mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3904 - RNA, 2296 nt, Artificial Sequence
  ZIKV prME variant mRNA Design 1 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3905 - RNA, 2308 nt, Artificial Sequence
  ZIKV prME variant mRNA Design 1 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3906 - RNA, 2332 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3907 - RNA, 2332 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3908 - RNA, 2332 nt, Artificial Sequence
  ZIKV prME variant mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3909 - RNA, 2329 nt, Artificial Sequence
  ZIKV prME variant mRNA Design 1 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3910 - RNA, 2326 nt, Artificial Sequence
  ZIKV prME variant mRNA Design 1 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3911 - RNA, 2323 nt, Artificial Sequence
  ZIKV prME variant mRNA Design 1 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3912 - RNA, 2320 nt, Artificial Sequence
  ZIKV prME variant mRNA Design 1 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3913 - RNA, 2317 nt, Artificial Sequence
  ZIKV prME variant mRNA Design 1 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3914 - RNA, 2314 nt, Artificial Sequence
  ZIKV prME variant mRNA Design 1 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3915 - RNA, 2311 nt, Artificial Sequence
  ZIKV prME variant mRNA Design 1 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3916 - RNA, 2308 nt, Artificial Sequence
  ZIKV prME variant mRNA Design 1 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3917 - RNA, 2305 nt, Artificial Sequence
  ZIKV prME variant mRNA Design 1 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3918 - RNA, 2302 nt, Artificial Sequence
  ZIKV prME variant mRNA Design 1 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3919 - RNA, 2299 nt, Artificial Sequence
  ZIKV prME variant mRNA Design 1 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3920 - RNA, 2296 nt, Artificial Sequence
  ZIKV prME variant mRNA Design 1 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3921 - RNA, 2293 nt, Artificial Sequence
  ZIKV prME variant mRNA Design 1 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3922 - RNA, 2290 nt, Artificial Sequence
  ZIKV prME variant mRNA Design 1 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3923 - RNA, 2287 nt, Artificial Sequence
  ZIKV prME variant mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3924 - RNA, 2287 nt, Artificial Sequence
  ZIKV prME variant mRNA Design 1 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3925 - RNA, 2299 nt, Artificial Sequence
  ZIKV prME variant mRNA Design 1 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3926 - RNA, 2323 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3927 - RNA, 2323 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3928 - RNA, 2329 nt, Artificial Sequence
  ZIKV prME variant mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3929 - RNA, 2323 nt, Artificial Sequence
  ZIKV prME variant mRNA Design 1 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3930 - RNA, 2326 nt, Artificial Sequence
  ZIKV prME variant mRNA Design 1 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3931 - RNA, 2320 nt, Artificial Sequence
  ZIKV prME variant mRNA Design 1 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3932 - RNA, 2317 nt, Artificial Sequence
  ZIKV prME variant mRNA Design 1 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3933 - RNA, 2314 nt, Artificial Sequence
  ZIKV prME variant mRNA Design 1 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3934 - RNA, 2311 nt, Artificial Sequence
  ZIKV prME variant mRNA Design 1 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3935 - RNA, 2308 nt, Artificial Sequence
  ZIKV prME variant mRNA Design 1 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3936 - RNA, 2305 nt, Artificial Sequence
  ZIKV prME variant mRNA Design 1 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3937 - RNA, 2302 nt, Artificial Sequence
  ZIKV prME variant mRNA Design 1 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3938 - RNA, 2299 nt, Artificial Sequence
  ZIKV prME variant mRNA Design 1 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3939 - RNA, 2296 nt, Artificial Sequence
  ZIKV prME variant mRNA Design 1 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3940 - RNA, 2293 nt, Artificial Sequence
  ZIKV prME variant mRNA Design 1 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3941 - RNA, 2290 nt, Artificial Sequence
  ZIKV prME variant mRNA Design 1 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3942 - RNA, 2287 nt, Artificial Sequence
  ZIKV prME variant mRNA Design 1 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3943 - RNA, 2284 nt, Artificial Sequence; identical to SEQ ID NO: 3849
  ZIKV (strain ZikaSPH2015) Polyprotein(108-794) mRNA Design 1 opt

SEQ ID NO: 3944 - RNA, 2284 nt, Artificial Sequence
  ZIKV prME variant mRNA Design 1 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3945 - RNA, 2296 nt, Artificial Sequence
  ZIKV prME variant mRNA Design 1 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3946 - RNA, 2320 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3947 - RNA, 2320 nt, Artificial Sequence
  ZIKV prME variant mRNA Design 1 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3948 - RNA, 2359 nt, Artificial Sequence; identical to SEQ ID NO: 3845
  KU321639.1 prME-long mRNA Design 1 opt

SEQ ID NO: 3949 - RNA, 2359 nt, Artificial Sequence; identical to SEQ ID NO: 3846
  KU312312.1 prME-long mRNA Design 1 opt

SEQ ID NO: 3950 - RNA, 2347 nt, Artificial Sequence; identical to SEQ ID NO: 3847
  AY632535.2 prME-long mRNA Design 1 opt

SEQ ID NO: 3951 - RNA, 2359 nt, Artificial Sequence; identical to SEQ ID NO: 3848
  KU527068.1 prME-long mRNA Design 1 opt

SEQ ID NO: 3952 - RNA, 2359 nt, Artificial Sequence
  KU720415.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauaccggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3953 - RNA, 2341 nt, Artificial Sequence
  DQ859059.1 prME-long mRNA Design 1 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugaugaaaaccgagccaagguagagguuacaccuaauucaccacgcgcagaggcuacucuuggcggguucggaagucugggcuuggacugugaacccagaaccggucucgauuuuagcgaccuguacuauuuaacaaugaacaauaaacacuggcuggugcauaaggagugguuccacgauauuccucucccauggcacgccggggcugacacuggcaccccgcauuggaacaauaaagaagcccuugucgaguuuaaggaugcacacgccaagaggcagacaguggucgugcugggaucccaggaaggcgcuguucauaccgcguuggcaggggcccuagaggcugagauggacggagccaaaggucggcuguucucuggccaccucaagugccgccugaaaauggauaaacuuagacugaagggggugagcuacucauuguguacugcagccuuuacguucacaaagguacccgcugaaacccuccauggaacugucaccguggagguucaguaugccggcacagacgguccuugcaaggugccagcacaaauggcggucgacaugcagacccugacucccguggggagguuaauaacagcuaacccuguaaucacggaaaguaccgagaacuccaaaaugaugcuggaacuagauccacccuuuggcgacagcuacauugugaucggaguuggcgauaagaaaauaacucaccacuggcaucguucugggucaacaauuggaaaggccuucgaggcaaccguccggggugccaaacgaauggcugugcucggcgacacagccugggauuucgggagugugggaggcgucuuuaauagccuggguaaggggauccaccagaucuucggcgcagcuuuuaagucccuuuucggaggcaugucuugguuuucgcaaauuuugaucgggacucugcucguuuggcugggacuuaacaccaaaaauggcagcauuucccugacguguuuggcccucgguggggugaugauauuccugucaaccgcggugagugccgacguaggaugcucugucgauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3954 - RNA, 2359 nt, Artificial Sequence
  KX377335.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccggaagaaaggggaagcacgcagauccaggcgggccgucacacuaccaucucauucgacccgcaagcuccaaacgcgaucacagacuuggcuggagagcagagaguauaccaagcaccuuauaaaaguggaaaauuggaucuuuaggaacccgggauucgcucugguugccguggcgauugcaugguugcucggcaguuccacaucucagaaggucaucuaccuggugaugauucugcucaucgcccccgcuuauagcauacggugcauuggcguauccaaucgugauuuuguugaggggaugucaggagguacuuggguggacgucguguuagaacauggcgggugugugaccgucauggcccaggauaaaccuacaguugacaucgagcuggugaccacgacuguaaguaacauggcagaggugcgcagcuacugcuacgaggcuucuauuuccgauauggccucagacagcagauguccaacacaaggagaagcguaucuugacaagcagagugauacccaguacgucugcaaaaggacuuugguggaccggggcugggguaauggguguggacuguucggcaagggcucucuaguuacaugcgccaaguuuaccugcuccaaaaagaugacggggaaaagcauccagcccgaaaaccucgaguaucgaaucaugcugucggugcacggaucucaacacuccgguaugauugucaaugauaccggcuacgaaacagacgagaaccgcgcaaagguggagguaacuccuaauucaccaagagcugaagccacccuugggggauucggcagucuggguuuggauugugagcccaggacagggcucgacuuuagcgaucuguauuacuuaacuaugaacaauaaacauuggcugguucacaaggaaugguuccaugacauaccucucccauggcacgcuggcgccgauaccggaacaccgcacuggaacaauaaagaggcacuuguggaauuuaaggacgcccaugcuaagcggcagaccgucgugguccugggcucccaggagggggcggugcacacugcauuggccggagcucuagaggccgaaauggauggugcaaaaggcaagcuguucucugggcaucucaaaugccgccugaagauggacaaacuuagacugaagggaguuagcuauucauuguguacggccgcuuuuacauucaccaaggugcccgccgagacucuccacggcaccguaacagucgaagugcaguacgcagguaccgacgggccuugcaaaaucccaguucaaauggcgguggauaugcagacucugacacccgucggcagguuaauuacggcuaacccugugaucaccgagaguacugaaaacuccaagaugaugcuggagcuagacccacccuuuggagauagcuacauaguaauuggcgugggggacaaaaagaucacacaucacuggcaccguucuggaucaaccaucgguaaagccuucgaggcaacaguucggggcgccaagcgaauggcuguccucggggauacugccugggacuucggaagugugggcgguguguuuaauagccuggggaagggcauucaucagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3955 - RNA, 2359 nt, Artificial Sequence
  LC002520.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugaccgucaaugauauuggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3956 - RNA, 2347 nt, Artificial Sequence
  KU963573.2 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugagaaucgagcaaaggucgaggugacaccuaacucaccacgcgcugaagccacucuugggggauucggcagucuggguuuggacugugagcccagaaccgggcucgauuuuagcgaccuguauuacuuaacaaugaauaacaaacacuggcugguacauaaggaaugguuccacgauauaccucucccauggcacgcuggcgccgacacuggaaccccgcauuggaauaacaaagaggcacuuguugaauuuaaggaugcccacgcuaagaggcagacaguggucgugcugggcucccaggagggggcgguccauaccgcauuggccggagcucuagaggccgaaauggacggugcaaaaggcaagcuguucucugggcaccucaaaugccggcugaagauggauaaacuucgccugaagggagugagcuauucauuguguacugccgcuuuuacguucacaaagguucccgccgagacccuccauggcacugugaccguagaaguccaguacgcagguacagacgggccuugcaaaaucccagugcaaauggcgguugacaugcagacccugacucccgugggcagauuaauuacagcuaauccugucaucacggagaguaccgaaaacuccaagaugaugcuggagcuagauccacccuuuggagacagcuacauagugauuggcguaggggauaaaaagaucacucaccacuggcauaggucuggaucaacaaucgguaaagccuucgaggcaaccgugcguggcgccaagcggauggcuguucucggggacacagccugggauuucggaagugucggcgguguguuuaacagccuggggaagggcauucaccagaucuucggagcagcuuuuaaaucccuuuucggcgggaugucuugguuuucgcaaauuuugauaggaacucugcucguguggcugggccuuaauaccaagaacgguagcaucucccugacguguuuggcccucgggggagucaugauuuuccugucaaccgcgguuagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3957 - RNA, 2359 nt, Artificial Sequence
  KX694534.2 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggagaggcauccaccagauuuucggagccgcuuuuaaauccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3958 - RNA, 2359 nt, Artificial Sequence
  KX447520.1 prME-long mRNA Design 1 opt
gggagaaagcuuaccaugagaaucauuaacgccaggaaggagaaaaagcggcgcggcgcugacgcaagcguggggauagucggacugcuccuuaccacagccauggcggcugaaguuacucgacgugguuccgccuacuauauguaccuggauagaaaugacgcaggcgaggccaucucuuuccccacgaccuuggggaugaacaaaugcuauauucagaucauggauuuaggacacaugugugacgcuacaaugucauacgaaugcccuaugcuggaugagggcguggaaccagacgauguagacuguuggugcaauacuaccaguacauggguggucuaugguaccugucaucacaagaaaggggaggcaaggcggagccgcagagccgugacucuaccgucccauucuacaaggaagcuccaaacccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3959 - RNA, 2359 nt, Artificial Sequence
  KX369547.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggacuggccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcgucggggagaaaaagauuacucaccacuggcaucguucuggaucaacaaucgguaaggcuuucgaggccaccgugcggggcgcaaaacgaauggcuguacugggggacacagccugggauuuuggaagugugggcggugcgcuuaacagcuuggggaaaggcauccaccagauuuucggagccgcuuucaagucccuguuuggcgggaugucuugguucucgcaaauccucauuggaacucugcuuauguggcugggcuugaauaccaagaacgguagcauaucccucaugugucuggcauuagggggaguucugaucuuucuaucaacggccgucagugcugacgugggcugcucuguggauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3960 - RNA, 2359 nt, Artificial Sequence
  KX447515.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacugguaucguucuggaucaacaaucgguaaggcuuuugaggccaccgugcggggcgcaaaacgaauggcuguacucggggacacagccugggauuucggaagugugggcggugcgcugaacagccuugggaaaggcauccaucagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3961 - RNA, 2359 nt, Artificial Sequence
  KU501217.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaauucguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3962 - RNA, 2359 nt, Artificial Sequence
  KU312314.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacuggcccaaauggcagucgauaugcagaccuuaacucccgugggcaggcugaucacagccaacccuguuauuacggaaaguaccgaaaauuccaagaugaugcuagagcucgacccacccuucggagauagcuacaucgugauaggcgucggggagaaaaagauuacucaccacuggcaucguucuggaucaacaaucgguaaggcuuuugaggccaccgugcggggcgcaaaacgaauggcuguacugggggacacagccugggauuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3963 - RNA, 2359 nt, Artificial Sequence
  KX446950.2 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuacccuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaauacgaagaacgguagcauauccuugaugugucucgcauuagggggaguucugaucuuccugucaaccgccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3964 - RNA, 2359 nt, Artificial Sequence
  KY003157.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggucgugagugccgacgugggcugcucugucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3965 - RNA, 2359 nt, Artificial Sequence
  KX811222.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaagugcuuggguggucuaugguaccugucaucacaagaaaggggaggcaaggcggagccgcagagccgugacucuaccgucccauucuacaaggaagcuccaaacccggccccagacguggcuggagucgcgcgaauacacuaagcaccuuauucgaguugagaacuggaucuuuagaaauccuggauucgcucuggccgcggcagccauagcuugguugcucggcucaagcaccagucagaaagugaucuaucuggucaugauucugcucaucgccccagcauacuccauuaggugcaucggcgugucuaaccgggauuuuguagaagggaugagcggagguacauggguugacguggucuuagagcauggcgggugugugacugugauggcucaggauaagcccaccgucgacauagagcugguuacaaccacgguguccaauauggccgaaguacguucauacugcuaugaggcgaguauuagcgauauggccucugacucccgcuguccuacucaaggagaagcauaccuugacaaacagucagauacacaguaugugugcaagagaaccuuggucgacaggggcugggguaacggguguggacuguucggcaaaggcagccuagugacuugcgcuaaguuugccugcaguaagaaaaugacagggaagucuauccagccagagaaucucgaauaccggauuaugcuguccguucacggaagccaacacucggguaugaucgugaacgauaccggccaugagacggacgagaaucgagcuaaagucgaaaucacccccaacucuccucgcgccgaggcaacacuugggggauucggcucccuggguuuggauugugaaccaagaacugggcucgacuuuucagaucuguauuacuuaaccaugaauaacaagcacuggcuggugcauaaagagugguuccacgacauuccgcuccccuggcacgccggcgcugauacaggaacuccucauuggaauaacaaggaagcgcuuguagaguuuaaagacgcacacgccaagaggcagaccguugugguccugggcagucaggagggggcugugcauacagccuuggcaggagcccuagaagcugagauggauggugccaagggccggcugagcuccgggcaccucaaaugccgccugaagauggacaaacuuagacugaagggagucucuuauagcuuguguaccgcagcguucacuuuuacgaaaauaccagcugaaacacuccauggcaccgugacuguugaggugcaguacgccgguaccgacgggcccugcaagguaccugcacaaauggccgucgauaugcagacacugaccccagugggcagguuaaucacugcuaaccccguuauuacagaaucaacggagaauaguaagaugaugcuggagcuagacccgccuuucggagauuccuacaucgugauaggcgucggggagaaaaagauuacccaccacuggcaucguagcggaucuacuaucgguaaagccuuugaagcaacagugcggggcgcuaagcgaauggccguacucggggacaccgcgugggauuucggaucagugggcggugcccugaacagucuugggaaaggcauccaccagauuuucggagcugcauuuaagagcuuguucggcgggauguccugguuuucucaaauccugauuggaacacuccugauguggcuuggccugaauacuaagaacgguucgaucagcuugaugugucucgccuuagggggaguucugauauuccuguccaccgcugucucagccgacgugggcugcaguguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3966 - RNA, 2359 nt, Artificial Sequence
  KX447516.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacauccaaaaaggugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaaaccaacagucgacauagagcugguuaccacgacugugucaaauauggcugaaguacguaguuacugcuaugaggccagcauuucugauauggcguccgacucacgcugucccacacagggagaagccuaccuugacaagcaaagcgauacccaguaugugugcaaaagaacuuuggucgacaggggcugggguaacggguguggacuguucggcaagggcagucuagugacaugcgcaaaguuugcuugcucuaaaaagaugaccgggaaauccauccagccugagaaucucgaauaccggauuaugcugagcguucacggaucgcagcacucugguaugaucgugaacgauacgggccaugagaccgacgagaaucgagccaaggucgaaaucacaccaaacucaccccgcgcugaggccacucuugggggauucggcucccuggguuuggauugugaaccuagaaccgggcucgacuuuagugaucuguauuacuuaacaaugaauaacaaacacuggcuggugcauaaggagugguuccacgacauuccacucccguggcacgcaggcgccgauacuggaacaccccauuggaauaacaaagaagcucuuguagaguuuaaggacgcgcacgcaaagaggcaaaccguugugguccugggcagccaggagggggccgugcauaccgcuuuggccggagcacuagaagccgagauggauggugcuaaaggccggcuguccucugggcaccucaagugccgccugaaaauggacaagcugagacugaaaggagucagcuauucauuguguacugccgcauucacguuuacaaagauaccugcggaaacccuccauggcacugugaccguugaggugcaguacgcugguacagacgggccaugcaagguacccgcccagauggcagucgauaugcaaacccugacuccugugggcagguuaaucacagccaacccaguuauuacggaaaguaccgaaaauuccaaaaugaugcuggagcuagaucccccguucggagacagcuacaucgugauaggcgucggggagaagaaaauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaagggcauccaccagauuuucggagccgcuuuuaaguccuuguucggcgggaugucuugguuuucgcagauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3967 - RNA, 2359 nt, Artificial Sequence
  KX520666.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaaggcagaaagugaucuaucuggucaugauucugcucaucgcuccugccuacuccauucggugcaucggcgugucuaaccgugauuuuguagaagggaugagcggagguacuuggguugacguggucuuagagcauggcgggugugugaccgugauggcacaggauaagccaacagucgacauagagcugguuaccacgacuguguccaauauggcugaaguacgcucauacugcuaugaggccaguauuagcgauauggcgucugacuccagaugucccacacaaggagaagccuaccuugacaaacagucagauacccaguaugugugcaagaggacuuuggucgaccggggcugggguaacggguguggacuguucggcaaaggcagccuagugacaugcgcaaaguuugcuugcaguaagaaaaugaccgggaagucuauccagccugagaaucucgaauaccgaauuaugcuguccguucacggaagccaacacucggguaugaucgugaacgauacgggccaugagaccgacgagaaucgcgccaaagucgaaaucacaccaaacucucccagagcugaggccacucuugggggauucggcucccuggguuuggauugugaaccuaggaccgggcucgacuuuucagaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagcggcagaccguugugguccugggcagucaggagggggccgugcauaccgcuuuggccggagcacuagaagccgagauggauggugcuaagggccgccugagcuccgggcaccucaaaugcagacugaagauggacaaacuuaggcugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggccguuuaaucacagccaacccaguuauuacggaaucaaccgagaauaguaagaugaugcuggagcuagaucccccguucggagacuccuacaucgugauaggcgucggggagaaaaagauuacucaccacuggcaucggagcggaucuacaaucgguaaggcuuuugaagccaccgugcgaggcgcaaaaagaauggcuguacucggggacacagccugggauuucggaucagugggcggugcgcugaacagucuugggaaaggcauccaccagauuuucggagccgcuuuuaagagcuuguucggcgggauguccugguuuucucaaauccugauuggaacucuccugauguggcuuggccugaauaccaagaacgguucgaucagcuugaugugucucgcauuagggggaguucugauauuccuguccacggccgucucagcugacgugggcugcaguguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3968 - RNA, 2359 nt, Artificial Sequence
  KU729218.1 prME-long mRNA Design 1 opt
gggagaaagcuuaccaugagaaucauuaacgccaggaaggagaaaaagcggcgcagcgcugacaccuccgugggcauagucgggcugcuccuuacaacugcaauggccgcggaaguuacgcgacguggaucugcuuacuauauguaccuggauagaaaugacgccggugaggcaaucucauuccccaccacauugggcaugaacaaaugcuauauucagaucauggauuuagggcacaugugugacgccacuaugaguuacgaaugcccuaugcuggaugagggaguggaaccagacgauguagacuguuggugcaauaccacaagcaccuggguggucuauggcacuugucaucacaagaaaggugaggcuaggcggucccgcagagcagugacacuaccgucucauucgaccaggaagcuccaaacgcggucacagacuuggcuggagagccgcgaauacaccaagcaccuuauucgaguugagaacuggaucuuuagaaaucccggguucgcccuggcugccgcggcaauagccugguugcucggaaguuccacaucucagaaagugaucuaucuggucaugauucugcucaucgcuccugccuacagcauuaggugcaucggcguguccaaccgggauuuuguagaaggcaugucagggggaacuuggguugacguggucuuagagcaugguggcugugugaccgugauggcacaggauaagccaacagucgacauagagcugguuaccacgacugugaguaauauggcugaaguacguagcuacugcuaugaggccucuauuuccgauauggcgucagacagccgcugucccacacaaggggaagccuaccuugacaaacagagugauacccaguaugugugcaagagaacuuuggucgacaggggauggggcaacgguugugggcuguucggaaaaggcucucuagugacaugcgcaaaguuugcuugcuccaagaaaaugaccggcaagagcauccagccugagaaucucgaauaccggauuaugcugucgguucacgggucucaacacuccggaaugaucgugaacgauacgggucaugagaccgacgagaaucgagccaaagucgaaaucacaccaaacucaccccgcgcugaggccacucuuggcggguucggaagucugggcuuggauugugaaccuagaaccggucucgacuuuagcgaucuguauuacuuaacaaugaauaacaagcacuggcuggugcauaaagagugguuccacgacauuccacucccguggcacgcaggggccgauacuggcacaccccauuggaauaacaaggaagcucuuguagaguuuaaagacgcgcacgcaaagaggcagaccguugugguccugggaucccaggagggcgccgugcauaccgcuuuggccggggcacuagaagccgagauggauggagcuaagggucggcugucuagcggccaccucaaaugccgccugaagauggacaaacuuagacugaagggggucucauauaguuuguguacugccgcauucacguuuacaaaaauaccugcggaaacccuccauggaacugugaccguugaggugcaguacgcuggcacagacgguccaugcaagguacccgcccaaauggcagucgauacccagacucugacaccuguggggagguuaaucacggccaacccaguuauuaccgaauccacugagaauagcaagaugaugcuggagcuagaucccccguucggcgacucuuacaucgugauaggagucggcgagaaaaagauuacacaccacuggcaucguucagggaguaccaucggaaaggcuuuugaagccacagugcggggugcaaaacgaauggcuguacucggcgacacugccugggauuucgggagcgugggaggcgcgcugaacucccuugguaaagggauccaccagauuuucggcgccgcuuuuaagucuuuguucggaggcaugucgugguuuagccaaauccugauugggacccuccugauguggcuuggacugaauacgaagaacggcuccauaucauugaugugucucgcacugggugggguuuuaaucuuccugaguaccgccgucucugcugacgugggaugcagcguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3969 - RNA, 2359 nt, Artificial Sequence
  KU761561.1 prME-long mRNA Design 1 opt
gggagaaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggaucuuuagaaaccccggauucgcccuggcugccgcggcaauagccugguugcucggcucaagcacaagucagaaagugaucuaucuggucaugauucugcucaucgcuccugccuacuccauuaggugcaucggcgugucuaaucgggauuuuguagaagggaugagcggagguacuuggguugacguggucuuagagcauggcgggugugugaccgugauggcacaggauaagccaacagucgacauagagcugguuaccacgacuguguccaacauggcugaaguacguucauacugcuaugaggccaguauuagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauccagccugagaaccucgaauaccggauuaugcuguccguucacggaagccaacacucggguaugaucgugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacauuccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaauccaguuauuacggaaucaaccgagaacaguaagaugaugcuggagcuagaucccccguucggagacuccuacaucgugauaggcgucggggagaaaaagauuacucaccacuggcaucguagcggaucuacaaucgguaaggcuuuugaagccaccgugcggggcgcacgaagaauggcuguacucggggacacagccugggauuucggaucagugggcggugcgcugaauagucuugggaaaggcauccaccagauuuucggagccgcuuuuaagagcuuguucggcgggauguccugguuuucucaaauccugauuggaacucuccugauguggcuuggccugaacaccaaaaaugguucgaucagcuugaugugucucgcauuagggggaguucugauauuccuguccacggccgucucagcugacgugggcugcaguguggauuuuucuaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3970 - RNA, 2359 nt, Artificial Sequence
  KY317938.1 prME-long mRNA Design 1 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggacuuuguagaggggauguccggagguacuuggguugauguggucuuagagcauggcgggugugugaccgugauggcacaggacaagccaacagucgauauagaacugguuaccacgacugugucaaauauggcugagguacguaguuacugcuaugaagccagcauuucugacauggcguccgauucacgcugucccacacaaggagaggccuaccuugacaaacagagcgacacccaguaugugugcaagagaacuuuggucgauaggggcugggguaacggguguggacuguucggcaaaggcagucuagugacaugcgcaaaguuugcuugcucuaagaaaaugaccgggaaguccauccagccugaaaaucucgaguaccggauuaugcugagcguucacggaucgcaacacucugguaugaucgugaacgacacgggccaugagaccgaugaaaaucgagccaaagucgagaucacaccaaacucaccccgcgcugaagccacucuugggggauucggcucccuggguuuggacugugagccuagaaccgggcucgauuuuagugaccuguauuacuuaacaaugaauaacaagcacuggcuggugcauaaagaaugguuccacgauauuccacucccguggcacgcaggcgccgacacuggaacaccccauuggaauaacaaggaggcucuuguagaguuuaaagaugcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3971 - RNA, 2359 nt, Artificial Sequence
  KY075939.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuuuaaggugcauuggcgugagcaaccgggauuuuguagaagggauguccggagguacuuggguugacgugguccuggagcauggcgggugugugaccgugauggcacaggauaagccaacagucgacaucgagcuuguuaccacgacugugucaaauauggcugaaguacguaguuacugcuaugaggccagcauaucugauauggcguccgacucacgcugucccacacaaggagaagccuacuuggacaaacagagcgauacccaguaugugugcaagagaacucuggucgacaggggcugggguaacggguguggacuauucggcaaaggcagucucgugacaugcgcaaaguuugcuugcucuaagaaaaugaccgggaaguccauucagccugagaaucuggaauaccggaucaugcuuagcguucacggaucgcaacacucugguaugauugugaacgauacgggccaugagaccgacgagaaucgagccaaagucgaaaucacaccaaacucaccccgcgcugaggccacucugggaggguucggcuccuugggucucgauugugaaccuagaaccgggcuggacuuuagugauuuauauuaccugacaaugaauaacaagcacuggcucgugcauaaagagugguuccacgacaucccacuuccguggcacgcaggcgccgauacuggaacaccccauuggaauaacaaggaagcucugguagaguuuaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauucacguuuacaaaaauuccugcggaaacccugcauggcacugugaccguugaggugcaguacgcugguacagacgggccaugcaagguacccgcccaaauggcagucgauaugcagaccuuaacuccugugggcaggcugauaacagccaacccaguuaucacggaaaguaccgaaaauuccaagaugaugcuagagcucgaucccccguucggagacagcuacauugugaucggcgucggggagaaaaagauaacucaccacuggcaucguucuggaucaacaauugguaaggcuuuugaggccaccgugcggggcgcaaaacgaauggcuguacugggggacacagccugggauuucggaagugugggcggugcgcuuaacagcuuggggaaaggcauccaccagaucuucggagccgcuuuuaagucccuguucggcgggaugucuugguuuucgcaaauucucaucggaacucugcuuauguggcugggcuugaauaccaagaacgguagcauuucccucaugugucuggcauuagggggaguucugauauuccuaucaacggccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3972 - RNA, 2359 nt, Artificial Sequence
  KX806557.2 prME-long mRNA Design 1 opt
gggagaaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggauguuuagaaaccccggauucgcccuggcugccgcggcaaucgccugguugcucggcucaagcacaagucagaaagugauauaucuggucaugauccugcucauugcuccugccuacuccaucaggugcauuggcgugucuaaucgggauuuuguagaagggaugagcggagguacuuggguugacguggucuuagagcauggcgggugugugaccgugauggcacaggauaagccaacagucgacaucgagcugguuaccacgacuguguccaacauggcugaaguacguucauacugcuaugaggccaguauaagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauucagccugagaaccucgaauaccggaucaugcuguccguucacggaagccaacacucggguaugauugugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacaucccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauuccugcggaaacccuccauggcacugugaccguugaggugcaguacgcugguacagacgggccaugcaagguacccgcccaaauggcagucgauaugcagacccugacuccugugggcagguuaauaacagccaauccaguuaucacggaaucaaccgagaacaguaagaugaugcuggagcuagaucccccguucggagacuccuacauugugaucggcgucggggagaaaaagauaacucaccacuggcaucguagcggaucuacaauugguaaggcuuuugaagccaccgugcggggcgcaaaacgaauggcuguacucggggacacagccugggauuucggaucagugggcggugcgcugaauagucuugggaaaggcauccaccagaucuucggagccgcuuuuaagagcuuguucggcgggauguccugguuuucucaaauucugaucggaacucuccugauguggcuuggccugaacaccaagaaugguucgauuagcuugaugugucucgcauuagggggaguucugauauuccuguccacggccgucucagcugacgugggcugcaguguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3973 - RNA, 2359 nt, Artificial Sequence
  KU870645.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggauccugagaaaucccggauuugccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcauuggggagaaaaagaucacucaccacuggcaucguucuggaucaacaaucgguaaggcuuucgaggccaccguccggggcgcaaaacgaauggcugugcugggggacacagccugggauuuuggaaguguaggcggugcgcuuaacagcuuggggaaaggcauucaccagaucuucggagccgcuuucaagucccuguuuggcgggaugucuugguucucgcaaauucucauaggaacucugcuuauguggcugggcuugaauaccaagaacgguagcaucucccucaugugucuggcauuagggggagugcugauuuuucuaucaacggccguuagugcugacgucggcugcucuguggauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3974 - RNA, 2359 nt, Artificial Sequence
  KU729217.2 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuucaaccacggugaguaauauggcugaaguacguagcuacugcuaugaggccacuauuucugauaucgcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccgccguugugcugggcagccaggagggggcuguccauaccgccuuggcaggagcccuagaagcugagauggauggugccaagggccggcuguccucugggcaccucaaaugccgccugaagauggacaaacuuagacugaagggagugagcuauucauuguguacugcagcguucacguuuacaaaaaucccugcugaaacccuccauggcacugucaccguggagguucaguacgccgguacagacgggccaugcaaggugcccgcacaaauggccguagauaugcagacccugacuccugucggcagguuaauuacagcuaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaagccuuugaggcaaccguccggggcgcuaagcgaauggccgugcucggggacacagcgugggauuucggaaguguaggcggugcccugaacagccuugggaaaggcauucaccagaucuucggagcugcauuuaaguccuuguucggcgggaugucuugguuuucgcaaauucugauaggaacucuccugauguggcuuggccugaauaccaagaacgguagcaucuccuugaugugucucgccuuagggggagugcugauuuuccugucaacggcuguuagugccgacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3975 - RNA, 2359 nt, Artificial Sequence
  KU497555.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacagcccccgcgcugaggccacucuugggggauucggcucacuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcacccaggagggggccgugcauacugcuuuggccggagcacuagaagccgagauggauggugcuaagggccggcugagcuccgggcaccucaaaugccgccugaagauggacaaacuuagacugaagggagucucuuauagcuuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaucaacugagaauaguaagaugaugcuggagcuagaucccccguucggagacuccuacaucgugauaggcgucggggagaaaaagauuacacaccacuggcaucguagcggaucuaccaucgguaaggcuuuugaagccacagugcggggcgcaaaacgaauggcuguacucggggacacugccugggauuucggaucagugggcggugcgcugaacagucuugggaaaggcauccaccagauuuucggagccgcuuuuaagagcuuguucggcgggauguccugguuuucucaaauccugauuggaacccuccugauguggcuuggccugaauacgaagaacgguucgauauccuugaugugucucgcauuagggggaguucugaucuuccuguccaccgccgucucagcugacgugggcugcaguguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3976 - RNA, 2359 nt, Artificial Sequence
  KX087101.3 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugagcugcaguacgcugguacagacgggccaugcaaggugcccgcccaaauggcaguagauaugcagaccuuaacuccugucggcaggcugaucacagccaacccagugauuacggaaaguaccgaaaauuccaagaugaugcuagagcucgaucccccguucggagacagcuacaucguuauaggcgugggggagaaaaagauuacucaccacuggcaucguucuggaucaacaaucgguaaggcuuuugaggccaccguccggggcgcaaaacgaauggcugugcugggggacacagccugggauuucggaaguguaggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggagugcugaucuuccuaucaacggccguuagugcugacgucggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3977 - RNA, 2359 nt, Artificial Sequence
  KY075932.1 prME-long mRNA Design 1 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaaucgaaaacuggauauuuagaaaucccggauucgcccuggcugccgcggcaaucgccugguugcucggcagcaguacaucccagaaaguuauuuaucuggugaugauccugcucauugcuccugccuacucuaucaggugcauaggcgucagcaaccgggacuuuguggaggggauguccggagguacuuggguagauguuguguuagagcauggcgggugugucaccgugauggcacaggacaagccaacaguggauauugaacuggucaccacgacuguuucaaauauggcugaggugcguaguuacugcuaugaagccagcaucucugacauggcguccgauucacgcugucccacacaaggagaggccuaccuugacaaacagagcgacacccaguauguaugcaagagaacuuugguggauaggggcugggguaacggguguggacuguucggcaaaggcagucuagucacaugcgcaaaguuugcuugcucuaagaaaaugaccgggaaguccauucagccugaaaaucucgaguaccggaucaugcugagcgugcacggaucgcaacacucugguaugaucguuaacgacacgggccaugagaccgaugaaaaucgagccaaaguggagauuacaccaaacucaccccgcgcugaagccacucuugggggauucggcucccuggguuuggacugugagccuagaaccgggcucgauuuuagugaccuguauuacuuaacaaugaauaacaagcacuggcugguccauaaagaaugguuccacgauauaccacucccguggcacgcaggcgccgacacuggaacaccccauuggaauaacaaggaggcucuuguggaguuuaaagaugcgcacgcaaagaggcagaccguaguugugcugggcagccaggaaggggccguccauaccgcuuuggccggagcacuagaggccgaaauggacggugcuaagggccggcuguccucugggcaccucaaaugccgccugaagauggauaaacuuagacugaagggagugagcuauucauuguguacugccgcauucacguuuacaaaaaucccugcggagacccuccauggcacugucaccguggaaguucaguacgcugguacagacgggccaugcaaggugcccgcccaaauggcaguagacaugcagacccugacuccugucggcagguuaauuacagccaacccagugaucacggagaguaccgaaaauuccaagaugaugcuggagcuagaucccccguucggagacagcuacauaguuauuggcgugggggagaaaaagaucacucaccacuggcaucguucuggaucaacaaucgguaaggcuuuugaagccaccguccggggcgcaaaacgaauggcugugcucggggauacagccugggacuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugaugucggcugcucuguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3978 - RNA, 2359 nt, Artificial Sequence
  KY014317.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaucgaaaauuccaagaugaugcuggagcuagaucccccguucggagacagcuacauagugauuggcgucggggagaaaaagaucacccaccacuggcaucguucuggaucaacuaucgguaaggcuuuugaggccacagugcggggcgcaaaacgaauggcuguacucggggacaccgccugggauuucggaagugugggcggugcgcugaacagccuugggaaaggcauucaccagaucuucggagccgcuuuuaaguccuuguucggcgggaugucuugguuuucgcaaauucugauaggaacacuccugauguggcuuggccugaauacuaagaacgguagcaucuccuugaugugucucgcauuagggggaguucugauuuuccugucaaccgccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3979 - RNA, 2359 nt, Artificial Sequence
  KU758876.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugucaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuucauguguuuggcucucgggggaguccugaucuuuuuaucaacggcagugagugccgacgugggcugcucugucgauuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3980 - RNA, 2359 nt, Artificial Sequence
  KU758874.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggcaaacuguccucugggcaccucaagugccggcugaaaauggacaagcugcgccugaaaggagucagcuauucauuguguacugccgcauucacguuuacaaagauaccugcggaaacccuccauggcacugugaccguugaggugcaguacgcugguacagacgggccaugcaagguacccgcccaaauggcagucgauaugcagacccugacuccugugggcagauuaaucacagccaacccaguuauuacggaaaguaccgaaaauuccaaaaugaugcuggagcuagaucccccguucggagacagcuacaucgugauaggcgucggggagaagaaaauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaagggcauccaccagauuuucggagccgcuuuuaaguccuuguucggcgggaugucuugguuuucgcaaauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3981 - RNA, 2359 nt, Artificial Sequence
  KY014314.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagaggcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3982 - RNA, 2359 nt, Artificial Sequence
  KU926310.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcuggugccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3983 - RNA, 2359 nt, Artificial Sequence
  KU761560.1 prME-long mRNA Design 1 opt
gggagaaagcuuaccaugagaaucauuaacgccggcaaggagaaaaagaggcgcggggcugacaccaaugugggaauagucggucugcuccuuacaacugcaauggccgcggaaguuacgcggcgaggcagcgcuuacuauauguaccuggaucguaacgacgccggggaggcaaucuccuuccccaccacauugggaaugaauaaaugcuauauucagaucauggauuuaggccacaugugugacgccacuaugucuuacgaaugcccuaugcuggaugaggguguggaaccagacgauguagacuguuggugcaacaccacaucaaccuggguggucuaugggacuugucaucacaagaaaggagaggcuagaaggagucggcgcgcagugacacuaccgagccauuccaccagaaagcuccaaacgaggucucagacuuggcuggagucgcgggaauacaccaagcaccuuauucgcguugagaauuggaucuuucgaaaccccggcuucgcccuggcugccgcggcaauagccugguugcucggcucaagcacaagucagaaagugaucuaucuggucaugauucugcucaucgcuccugccuacuccauuagaugcaucggggugucuaauagggauuuuguagaaggaaugagcgguggcacuuggguugacguggucuuagagcaugggggaugugugaccgugauggcacaggauaagccaacagucgacauagagcugguuaccacgacuguguccaacauggcugaaguacggucauacugcuaugaggccaguauuagcgauauggcgucugacucccguugucccacacaaggcgaagccuaccuugacaaacagucagauacccaguaugugugcaagcgcacuuuggucgacagagguugggggaauggauguggccuguucggcaaagggagccuagugacaugcgcaaaguuugcuugcaguaagaaaaugaccggaaagucuauccagccugagaaccucgaauacaggauuaugcuguccguucacgguagccaacacucgggcaugaucgugaaugauacggggcaugagaccgacgagaaccgggccaaagucgaaaucacaccaaauucuccccgagcugaggccacucuuggaggcuucgguucccugggguuggauugugaaccucgcaccggccucgacuuuucagaucuguauuacuuaacaaugaacaauaagcacuggcuggugcauaaagagugguuccacgacauuccacucccguggcacgcaggagccgauacuggcacaccccauuggaacaacaaggaagcucuuguagaguuuaaagacgcgcacgcaaagagacagaccguugugguccuggggagucaggagggagccgugcauaccgcuuuggccggugcacuagaagccgagauggauggcgcuaaggggaggcugagcuccggacaccucaaaugccggcugaagauggacaaacuucgccugaagggcgucucuuauagcuuguguacugccgcauucacguuuacaaaaauaccugcggaaacccuccaugguacugugaccguugaggugcaguacgcugggacagacggcccaugcaagguacccgcccaaauggcagucgauaugcagacccugacuccugugggaagauuaaucacagccaauccaguuauuacggaaucaaccgagaacaguaagaugaugcuggagcuagaucccccguucggcgacuccuacaucgugauaggggucggagagaaaaagauuacucaccacuggcauaggagcgguucuacaaucggcaaggcuuuugaagccaccgugcguggggcacggcgaauggcuguacucggagacacagccugggauuucggcucaguggguggggcgcugaauagucuuggcaaaggaauccaccagauuuucggcgccgcuuuuaagagcuuguucgggggaauguccugguuuucucaaauccugauuggcacucuccugauguggcuuggucugaacaccaaaaaugggucgaucagcuugaugugucucgcacugggaggcguuuuaauauuccuguccacggccgucucagcugacguggguugcaguguggauuuuucuaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3984 - RNA, 2359 nt, Artificial Sequence
  KY317939.1 prME-long mRNA Design 1 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaagaugccggcgaagcaaucucuuuccccaccacauuggggaugaauaagugcuauauucagaucauggacuuaggacacaugugugaugccacuaugucauacgagugcccuaugcuggacgaaggcguggagccagaugacguagauuguuggugcaacaccacaaguaccuggguggucuaugguacuugucaucacaaaaagggggaggcuaggcggagccgcagagcagugacacuaccgucccauucuaccaggaagcuccaaacgcggucgcagacuuggcuggaaucacgcgaguacaccaaacaccuuauucgaguugaaaauuggaucuuuagaaaccccggauucgcccuggcugccgcggcaauagccugguugcucggcagcaguacaucccagaaggugaucuaucuggucaugauucugcucaucgcuccugccuacucuauuaggugcaucggcgugagcaaucgggacuuuguagaggggauguccggagguacuuggguugauguggucuuagagcauggcgggugugugaccgugauggcacaggacaaaccaacagucgauauagaacugguuaccacgacugugucaaacauggcugagguacguaguuacugcuaugaagccagcauuucugacauggcguccgauucacgcugucccacacaaggagaggccuaccuugacaagcagagcgacacccaguaugugugcaaaagaacuuuggucgauaggggcugggguaauggguguggacuguucggcaagggcagucuagugacaugcgcaaaguuugcuugcucuaaaaagaugaccgggaaauccauccagccugaaaaccucgaguaccggauuaugcugagcguucacggaucgcaacacucugguaugaucgugaaugacacgggccaugagaccgaugaaaaccgagccaaggucgagaucacaccaaauucaccccgcgcugaagccacucuugggggauucggcucccuggguuuggacugugagccuagaaccgggcucgauuuuagugaccuguauuacuuaacaaugaacaauaaacacuggcuggugcauaaggaaugguuccacgauauuccacucccguggcacgcaggcgccgacacuggaacaccccauuggaacaauaaagaggcucuuguagaguuuaaggaugcgcacgcaaagaggcagaccguugugguccugggcagccaggaaggggccgugcauaccgcuuuggccggagcacuagaggccgaaauggacggugcuaaaggccggcuguccucugggcaccucaagugccgccugaaaauggauaagcugagacugaaaggagucagcuauucauuguguacugccgcauucacguuuacaaagauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgagaacuccaaaaugaugcuggaacuagaucccccguucggagacagcuacaucgugauaggcgucggggagaagaaaauuacucaccacuggcaucguucuggaucaacaaucgguaaggcuuuugaagccaccgugcggggcgcaaaacgaauggcuguacucggggauacagccugggacuucggaagugugggcggugcgcugaauagccuugggaagggcauccaccagauuuucggagccgcuuuuaaguccuuguucggcgggaugucuugguuuucgcaaauccugauuggaacucuccugauguggcuuggccugaacaccaaaaaugguagcauauccuugaugugucucgcacuugggggaguuuuaaucuuccugucaacggccgucagugcugaugugggcugcucuguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3985 - RNA, 2359 nt, Artificial Sequence
  KY075937.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauaugguguccgacucacgcugucccacacaaggagaagcguaccuugacaaacagagcgauacccaguaugucugcaagagaacuuugguggacaggggcugggguaacggguguggacuguucggcaaaggcagucuaguuacaugcgccaaguuugcaugcucuaagaaaaugaccgggaaguccauccagccugagaaucucgaauaccggauuaugcugagcgugcacggaucgcaacacucugguaugaucgucaacgauacgggccaugagaccgacgagaaucgagcuaaaguggaaaucacaccaaacucaccccgcgccgaggcuacucuugggggauucggcucccuggguuuggauugugaaccuagaaccgggcucgacuuuagugaucuguauuacuuaacaaugaauaacaagcacuggcugguacauaaagagugguuccacgacauuccacucccguggcacgccggcgcagauacuggaacaccccauuggaauaacaaggaagcccuuguugaguuuaaagacgcucacgcgaagaggcagaccguggucgugcugggcagccaggagggggcaguccauaccgccuuggcuggagcccuagaagcagagauggauggugccaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuugaugugucucgcuuuagggggaguccugaucuuccugucaacggcagugagugccgacgugggcugcucugucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3986 - RNA, 2359 nt, Artificial Sequence
  LC191864.1 prME-long mRNA Design 1 opt
gggagaaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaugaccucaacauggguggucuaugguaccugucaucacaagaaaggggaggcuaggcggagucgcagagcagugacucuaccgagccauuccacaaggaagcuccaaacccggucucagacguggcuggagucgcgcgaauacacuaagcaccuuauucgaguugagaauuggaucuuuagaaaccccggauucgcccuggcugccgcggcaauagccugguugcucggcucaagcaccagucagaaagugaucuaucuggucaugauucugcucaucgcuccugccuacuccauuaggugcaucggcgugucuaaucgggauuuuguagaagggaugagcggagguacauggguugacguggucuuagagcauggcgggugugugacugugauggcacaggauaagccaaccgucgacauagagcugguuacaaccacgguguccaacauggcugaaguacguucauacugcuaugaggccaguauuagcgauauggcgucugacucccgcugucccacucaaggagaagccuaccuugacaaacagucagauacacaguaugugugcaagagaaccuuggucgacaggggcugggguaauggguguggacuguucggcaaaggcagccuagugacuugcgcaaaguuugcuugcaguaagaaaaugacagggaagucuauccagccugagaaccucgaauaccggauuaugcuguccguucacggaagccaacacucggguaugaucgugaaugauaccggccaugagacggacgagaaccgagccaaagucgaaaucaccccaaauucuccccgcgcugaggccacacuugggggauucggcucccuggguuuggauugugaaccuagaacugggcucgacuuuucagaucuguauuacuuaaccaugaacaauaagcacuggcuggugcauaaagagugguuccacgacauuccacucccguggcacgcaggcgccgauacaggaacuccccauuggaacaacaaggaagcucuuguagaguuuaaagacgcgcacgcaaagaggcagaccguugugguccugggcagucaggagggggccgugcauacagcuuuggccggagcacuagaagccgagauggauggugcuaagggccggcugagcuccgggcaccucaaaugccgccugaagauggacaaacuuagacugaagggagucucuuauagcuuguguaccgccgcauucacuuuuacgaaaauaccugcggaaacacuccauggcaccgugacuguugaggugcaguacgcugguaccgacgggccaugcaagguacccgcccaaauggcagucgauaugcagacacugaccccugugggcagguuaaucacugccaauccaguuauuacagaaucaacggagaacaguaagaugaugcuggagcuagaucccccguucggagacuccuacaucgugauaggcgucggggagaaaaagauuacccaccacuggcaucguagcggaucuacuaucgguaaggcuuuugaagccacagugcggggcgcaaaacgaauggcuguacucggggacaccgccugggauuucggaucagugggcggugcgcugaauagucuugggaaaggcauccaccagauuuucggagccgcuuuuaagagcuuguucggcgggauguccugguuuucucaaauccugauuggaacacuccugauguggcuuggccugaacacuaagaaugguucgaucagcuugaugugucucgcauuagggggaguucugauauuccuguccaccgccgucucagcugacgugggcugcaguguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3987 - RNA, 2359 nt, Artificial Sequence
  KX447517.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccgcacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaacacugaucggaacucuccugauguggcuuggccugaauaccaagaacgguagcauuuccuugaugugucucgccuuagggggaguucugauauuccugucaacggcugucagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3988 - RNA, 2359 nt, Artificial Sequence
  KU922923.1 prME-long mRNA Design 1 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuuuagccuacucuauuaggugcaucggcgugagcaaccgggacuuuguagaggggauguccggagguacuuggguugaugugguccuggagcauggcgggugugugaccgugauggcacaggacaagccuacagucgauauagaacuuguuaccacgacugugucaaauauggcugagguacguaguuacugcuaugaagccagcauuucugacauggcguccgauucacgcuguccaacacaaggagaggccuacuuggacaaacagagcgacacccaguaugugugcaagagaacucuggucgauaggggcugggguaacggguguggacuauucggcaaaggcagucucgugacaugcgcaaaguuugcuugcucuaagaaaaugaccgggaaguccauccagcccgaaaaucuggaguaccggauuaugcuuagcguucacggaucgcaacacucugguaugaucgugaacgacacgggccaugagaccgaugaaaaucgagccaaagucgagaucacaccuaacuccccacgcgcugaagccacucugggaggguucggcucauugggucucgacugugagcccagaaccgggcuggauuuuagugacuuauauuaccugacaaugaauaacaagcacuggcucgugcauaaagaaugguuccacgauauuccucuuccauggcacgcaggcgccgacacuggaaccccgcauuggaauaacaaggaggcucugguagaguuuaaagaugcgcacgcaaagaggcagacaguuguggucuugggcagccaggaaggggccgugcauaccgcucuagccggagcacuggaggccgaaauggacggugcuaagggccggcucuccucugggcaccugaaaugccgccuuaagauggauaaacugagauugaagggagucagcuauucacucuguacugccgcauucacguuuacaaaaauacccgcggagacccugcauggcacugugaccguugaagugcaguacgcugguacagacgggccuugcaagguaccagcccaaauggcagucgacaugcagaccuuaacucccgugggcaggcugaucacagccaacccuguuauuacggagaguaccgaaaauuccaagaugaugcuagagcucgauccacccuucggagacagcuacaucgugauaggcgucggggagaaaaagauuacucaccacuggcaucguucuggaucaacaaucgguaaggcuuuugaagccaccgugcggggcgcaaaacgaauggcuguacugggggauacagccugggacuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugaugugggcugcucuguggacuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3989 - RNA, 2359 nt, Artificial Sequence
  KY003156.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcauaagcaaccgggauuuuguggaagggauguccggagguacuuggguagacguuguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcauacuggguuuggauugugaaccuagaaccgggcucgacuuuuccgaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagaggcagaccguaguugugcugggcagucaggagggggccguccauaccgcuuuggccggagcacuagaagccgagauggauggugcuaagggccggcugagcuccgggcaccucaaaugccgccugaagauggacaaacuuagacugaagggagugucuuauagcuuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagguuaaucacagccaacccagugauaacggaaucaaccgagaauaguaagaugaugcuggagcuagaucccccguucggagacuccuacauuguuaucggcgugggggagaaaaagaucacucaccacuggcaucguagcggaucuacaauugguaaggcuuuugaagccaccguccggggcgcaaaacgaauggcugugcucggggacacagccugggauuucggaucaguaggcggugcgcugaacagucuugggaaaggcauccaccagauuuucggagccgcuuuuaagagcuuguucggcgggauguccugguuuucucaaauacugaucggaacucuccugauguggcuuggccugaauaccaagaacgguucgauuagcuugaugugucucgcauuagggggagugcugaucuuccuguccacggccguuucagcugacgucggcugcaguguggauuuuucuaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3990 - RNA, 2359 nt, Artificial Sequence
  KU312313.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuauuaggaagcuccaaacgcggucgcagacuuggcuggagucacgcgaauacaccaagcaccuuauccgaguugagaacuggauauuuagaaaucccggauucgcccuggcugccgcggcaaucgccugguugcucggcagcaguacaucccagaaagugauuuaucuggucaugauccugcucauugcuccugccuacucuaucaggugcauaggcgugagcaaccgggauuuuguagaagggauguccggagguacuuggguugacguggucuuagagcauggcgggugugugaccgugauggcacaggauaagccaacagucgacauugagcugguuaccacgacugugucaaauauggcugaaguacguaguuacugcuaugaggccagcaucucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaaucccugcggaaacccuccauggcacugugaccguugaggugcaguacgcugguacagacgggccaugcaagguacccgcccaaauggcagucgauaugcagacccugacuccugugggcagguuaauuacagccaacccaguuaucacggaaaguaccgaaaauuccaagaugaugcuggagcuagaucccccguucggagacagcuacauagugauuggcgucggggagaaaaagaucacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauucaccagaucuucggagccgcuuuuaaguccuuguucggcgggaugucuugguuuucgcaaauucugauaggaacucuccugauguggcuuggccugaaugcaaagaacgguagcaucuccuugaugugucucgccuuagggggaguucugauuuuccugucaaccgcugucagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3991 - RNA, 2359 nt, Artificial Sequence
  KY075935.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcucaaaggagccggcgcgcagugacacuaccgucccauucuaccagaaagcuccagacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacguggucuuagagcauggcgggugugugaccgugauggcacaagauaagccaacagucgacauagagcugguuaccacgacugugucaaauauggcugaaguacggaguuacugcuaugaggccagcauuucugauauggcguccgacucacguugucccacacagggagaagccuaccuugacaaacagagcgauacccaguaugugugcaagcgcacuuuggucgacagaggcugggguaacggguguggacuguucggcaaaggcagucuagugacaugcgcaaaguuugcuugcucuaagaaaaugaccgggaaguccauccaaccugagaaucucgaauacaggauuaugcugagcguucacggaucgcagcacucugguaugaucgugaacgauacgggccaugagaccgacgagaaucgggccaaagucgaaaucacaccaaacucaccccgagcugaggccacucuugggggauucggcucccuggguuuggauugugaaccucgcaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagagacagaccguugugguccugggcagccaggagggggccgugcauaccgcuuuggccggagcacuagaagccgagauggauggugcuaagggcaggcuguccucugggcaccucaaaugccggcugaagauggacaaacuucgccugaagggagucagcuauucauuguguacugccgcauucacguuuacaaaaauaccugcggaaacccuccauggcacugugaccguugaggugcaauacgcugguacagacgggccaugcaagguacccgcccagauggcagucgauaugcagacccugacuccugugggcagauuaaucacagccaacccaguuauuacggaaaguaccgaaaauuccaagaugaugcuggagcuagaucccccguucggagacagcuacaucgugauaggcgucggggagaaaaagauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaaaggcauccaccaaauuuucggagccgcuuuuaaguccuuguucggcgggaugucuugguuuucgcagauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3992 - RNA, 2359 nt, Artificial Sequence
  KY014320.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaagcccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3993 - RNA, 2359 nt, Artificial Sequence
  KX827309.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaucugacgccggcgaggcaaucucauuccccaccacauuggggaugaauaaaugcuauauucagaucauggauuuaggacacaugugugacgccacuaugaguuacgaaugcccuaugcuggaugagggcguggaaccagacgauguagacuguuggugcaacaccacaagcaccuggguggucuaugguacuugucaucacaagaaaggggaggcuaggcggucccgcagagcagugacacuaccgucucauucgaccaggaagcuccaaacgcggucacagacuuggcuggagagccgcgaauacaccaagcaccuuauucgaguugagaauuggaucuuuagaaaccccggauucgcccuggcugccgcggcaauagccugguugcucggcaguuccacaucucagaaagugaucuaucuggucaugauucugcucaucgcuccugccuacagcauuaggugcaucggcguguccaaucgggauuuuguagaagggaugucaggagguacuuggguugacguggucuuagagcauggcgggugugugaccgugauggcacaggauaagccaacagucgacauagagcugguuaccacgacugugaguaacauggcugaaguacguagcuacugcuaugaggccucuauuuccgauauggcgucagacagccgcugucccacacaaggagaagccuaccuugacaaacagagugauacccaguaugugugcaagagaacuuuggucgacaggggcugggguaauggguguggacuguucggcaaaggcucucuagugacaugcgcaaaguuugcuugcuccaagaaaaugaccgggaaaagcauccagccugagaaccucgaauaccggauuaugcugucgguucacggaucucaacacuccgguaugaucgugaaugauacgggccaugagaccgacgagaaccgagccaaagucgaaaucacaccaaauucaccccgcgcugaggccacucuugggggauucggcagucuggguuuggauugugaaccuagaaccgggcucgacuuuagcgaucuguauuacuuaacaaugaacaauaagcacuggcuggugcauaaagagugguuccacgacauuccacucccguggcacgcaggcgccgauacuggaacaccccauuggaacaauaaggaagcucuuguagaguuuaaagacgcgcacgcaaagaggcagaccguugugguccugggcucccaggagggggccgugcauaccgcuuuggccggagcacuagaagccgagauggauggugcuaagggccggcugucuagcgggcaccucaaaugccgccugaagauggacaaacuuagacugaagggagucucauauaguuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaauccaccgagaacagcaagaugaugcuggagcuagaucccccguucggagacucuuacaucgugauaggcgucggggagaaaaagauuacucaccacuggcaucguucaggaaguacaaucgguaaggcuuuugaagccaccgugcggggcgcaaagcgaauggcuguacucggggacacagccugggauuucggaagcgugggcggugcgcuuaauucccuggggaaaggcauccaccagauuuucggagccgcuuuuaagucuuuguucggcgggaugucgugguuuagccaaauccugauuggaacucuccugauguggcuuggccugaacaccaagaaugguuccauaucauugaugugucucgcauuagggggaguucugaucuuccugaguacggccgucucugcugacgugggcugcagcguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3994 - RNA, 2359 nt, Artificial Sequence
  KU681081.3 prME-long mRNA Design 1 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacaccggcgccgauacaggaacuccccauuggaacaauaaggaagcacuuguagaguuuaaagacgcccacgcuaagaggcagaccguugugguccugggcucccaggagggggcggugcauacggcauuggccggagcucuagaagccgagauggauggugcaaagggccggcugucuagcgggcaccucaaaugccgccugaagauggacaaacuuagacugaagggagucucauauaguuuguguacagccgcuuucaccuuuacuaaaauaccugccgaaacccuccauggcacagugaccguugaggugcaguacgcagguacugacgggccaugcaagguacccgcgcaaauggcugucgauaugcagacacugacgccugugggcagguuaaucaccgccaacccaguuauuacugaaggaacagagaacuccaagaugaugcuggagcuagaucccccguucggcgacagcuacaucgugauaggggucggagaaaagaagauuacccaccacuggcaucguucugguucaacaaucggcaaagcauuugaggccacugugcgaggggcuaagcggauggccguacucggagacaccgcaugggauuucggcagugugggugggguucugaauagccuuggcaaaggaauccaccagauuuucggcgcugccuuuaaguccuuguucgggggaaugucuugguuuucgcaaauccugauuggcacgcuccugauguggcuuggucugaacaccaagaaugggagcauauccuugaugugucucgcgcugggaggcgucuuaaucuuccugucaacagccgugagugcugacguggguugcucugucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3995 - RNA, 2359 nt, Artificial Sequence
  KU744693.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgcaauggcucaggauaagccaacaguggacauagagcuggucaccacgacuguuucaaauauggccgaagugcguaguuacugcuaugaggcgagcauuucugauauggccuccgacucacgcugucccacacaaggagaagcauaccuugacaaacagagcgauacccaguauguaugcaagagaacuuugguggacaggggcugggguaacggguguggacuguucggcaaaggcagucuagucacaugcgcuaaguuugccugcucuaagaaaaugaccgggaaguccauccagccugagaaucucgaauaccggauuaugcugagcgugcacggaucgcaacacucugguaugcuuguuaacgauacgggccaugagaccgacgagaaucgagcuaaaguggaaaucacaccaaacucaccccgcgccgaggcaacucugggaggguucggcuccuugggucucgauugugaaccuagaaccgggcuggacuuuagugauuuauauuaccugacaaugaauaacaagcacuggcucgcccauaaagagugguuccacgacaucccacuuccguggcacgcuggcgcggcaacuggaacaccccauuggaauaacaaggaagcccuggucgaguuuaaagaugcucacgccaagaggcagaccgugguaguuuugggcagccaggagggggcagugcauaccgcccuagcuggagcccuggaagcagagauggacggugcgaagggccggcucuccucugggcaccugaaaugccgccuuaagauggauaaacugagauugaagggagucagcuauucacucuguacugcugccuucacguuuacaaaaauuccugcagaaaccguggacggcacugucaccguggagggucaguacgggggcacagacggaccaugcaagguucccgcccaaauggcuguggauaugcagacccugacuccuguaggcagguuaauaacagccaacccagucaucacggaaaguaccgaaaauuccaagaugaugcuggagcuagaucccccguucggggacagcuacauugugaucggaguuggugagaaaaagauaacucaucacuggcaccguucuggcucaacaauugggaaagcauuugaggcuaccgugcggggagccaagcgaauggcgguccucggcgacacagccugggauuucgguaguguagggggcgcucugaacagccuuggaaaaggcauccaucagaucauuggggcagccuucaaguccuuguuuggaggcaugucuugguucucgcaaauccugauugguacucuccugauguggcuugggcugaauaccaagaacggaagcauauccuugaugugucucgcucugggcgguguguuaaucuuucugucaacggccgugaguggcgggguuggaugcucugucgacuucagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3996 - RNA, 2359 nt, Artificial Sequence
  KY328290.1 prME-long mRNA Design 1 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaagucuauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuuccaaaauaccugcagaaacccuccauggcacugugaccgaggaaguucaguacgcggguacagacgggccaugcaaggugcccgcucaaauggccguagauaugcagacccugacuccugucggcagguuaaucacagcaaacccagugauuacggagagcaccgagaacucuaagaugaugcuggaacuagaucccccguucggagacucauacaucguuauaggcgugggggagaaaaagauuacucaccacuggcaucguaguggaagcacaaucgguaaagccuuugaagcuaccguccggggcgccaagcgaauggcagugcucggggacacagcuugggauuucggauccguaggcggugcccugaauagccuugggaaaggcauccaccagauuuucggagcggccuuuaagucguuguucggcgggaugagcugguuuucccaaauccugauuggaacucuccugauguggcuuggccugaacaccaagaaugguucaauaaguuugaugugucucgcuuuagggggagugcugaucuuccugucuacggcaguuagcgccgacgucggcugcuccguggauuuuucaaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3997 - RNA, 2359 nt, Artificial Sequence
  KX694532.2 prME-long mRNA Design 1 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugaugugucucgcuuuagggggaguucugaucuuccugaguaccgcagucucugccgacgugggcugcagcguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3998 - RNA, 2359 nt, Artificial Sequence
  KU955593.1 prME-long mRNA Design 1 opt
gggagaaagcuuaccaugagaaucauuaacgccaggaaggagaaaaagcggcgcggcaccgacacaagcguggggauagucggacugcuccuuacuacggcuauggcaguugaagugacccgacgugguaaugccuacuauauguaccuggauagauccgacgcgggcgaggcuaucucuuuccccacaacuauggggaugaacaaaugcuauauucagaucauggauuugggacacaugugugacgccaccaugucauacgaaugcccuauguuagaugagggcguagaaccagacgauguggacuguuggugcaauacaaccaguacuugggucguguaugguacaugucaucacaagaaaggggaggcaaggcggagccgcagagccguuacccugccgucccauucuacgaggaagcuacaaacucggucgcagaccuggcucgagucacgcgaauacacaaagcaccugauucgaguggagaacuggaucuuuagaaaucccggauucgcucuugcagccgcugccauagcguggcuguugggcagcaguacuucccagaaagucaucuaucucgugaugauucugcugaucgcacccgccuacucuauuaggugcaucggcguaagcaaccgggauuuuguugaagggauguccggagguaccuggguggacgucgugcucgagcauggcgggugugugacagucauggcucaggauaagccaaccguugacauagaguuagugacgacuacaguaucaaauauggccgaagugcguaguuacugcuaugaggcaagcauuucugauauggcuuccgacucacgcugucccacccaaggagaagccuaccuggacaaacagagcgauacucaguaugucugcaagagaacacuuguggacaggggcugggguaacggguguggauuguucggcaaaggcagucugguuaccugcgcgaaguuugccugcucuaagaaaaugacggggaaguccauccagccugagaaucuagaauaccggauuaugcucagcgugcacggaucgcaacacucugguaugaucgucaacgauaccggccaugagacagacgagaaucgagcaaaaguggaaaucacuccaaacuccccucgcgcugaggccacccuugggggauucggcucacugggucuggauugugaaccuagaacaggguuggacuuuagugaucucuauuaccugacuaugaauaacaagcacugguuaguacauaaagagugguuccacgacauuccacugccguggcacgcuggcgccgauaccggaacaccccauuggaauaacaaggaagcacucguugaguuuaaagacgcccacgcuaagaggcagaccguggucgugcuuggcagccaggagggggcgguccauacugcacuggccggagcuuuggaagccgagauggauggugcaaagggccggcuauccucugggcaccugaaaugccgccucaagauggacaaacugagacuuaagggagugagcuauucacuguguacggccgcuuucacauuuaccaaaauaccugccgaaacuuugcauggcaccguuacaguggagguacaguacgcagguaccgacgggccaugcaagguccccgcgcaaauggcuguggauaugcagacucucacaccuguuggcaggcugaucacggccaacccagugauuaccgaaaguacugaaaauuccaagaugauguuagagcuggaucccccguucggagacagcuacaucgucauaggcgugggggagaaaaagauuacacaccacuggcaucguucuggaucaaccaucgguaaagcauuugaggccacaguacggggcgcuaagcgaauggccgugcuaggggacacugcaugggauuucggaaguguuggcggugcucucaacagccuggggaaaggcauccaccagauuuucggagccgcguuuaagucccuuuucggcgggaugucuugguuuucgcaaaucuugauuggaacccugcucgucuggcugggccuuaauacgaagaacgguagcauaucccugauguguuuggcccucgggggagugcugaucuucuuaucaaccgcugugagugcagacgucggcugcucuguugauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3999 - RNA, 2359 nt, Artificial Sequence
  KY272987.1 prME-long mRNA Design 1 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugguuugucucgcuuuagggggaguccugaucuuccugaguaccgcagugucugccgacgugggcugcagcgucgauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4000 - RNA, 2359 nt, Artificial Sequence
  EU545988.1 prME-long mRNA Design 1 opt
gggagaaagcuuaccaugagaaucauuaacgccaggaaggagaaaaagcggcgcggcaccgacacaagcguggggauagucggacugcuccuuacuacggcuauggcaguugaagugacccgacgugguuccgccuacuauauguaccuggauagaucugacgcgggcgaggcuaucucauuccccacaacuuuggggaugaauaaaugcuauauucagaucauggauuuaggacacaugugugacgccaccaugaguuacgaaugcccuaugcuggaugagggcguagaaccagacgauguggacuguuggugcaacacaaccagcacuugggucguguaugguacaugucaucacaagaaaggggaggcaaggcggucccgcagagccguuacccuaccgucucauucgacgaggaagcuccaaacucggucacagaccuggcuggagagccgcgaauacacaaagcaccuuauucgaguggagaauuggaucuuuagaaaccccggauucgcucuggcagccgcugccauagcgugguugcucggcaguuccacuucucagaaagucaucuaucuggugaugauucugcucaucgccccugcauacagcauuaggugcaucggcguauccaaucgggauuuuguugaagggaugucaggagguaccuggguggacgucguguuagagcauggcgggugugugacagucauggcucaggauaagccagccguugacauagagcuggugaccacgacuguaaguaacauggcagaagugcguagcuacugcuaugaggcuucuauuuccgauauggccucagacagccgcugucccacacaaggagaagcguaccuugacaaacagagugauacccaguaugucugcaagagaacuuugguggacaggggcugggguaauggguguggacuguucggcaaaggcucucuaguuacaugcgccaaguuugcaugcuccaagaaaaugaccgggaaaagcauccagccugagaaccucgaauaccggauuaugcugucggugcacggaucucaacacuccgguaugaucgucaaugauacgggccaugagaccgacgagaaccgagcuaaaguggaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguacauaaagagugguuccacgacauuccacucccguggcacgccggcgcagauacuggaacaccccauuggaacaauaaggaagcccuuguugaguuuaaagacgcucacgcgaagaggcagaccguggucgugcugggcucccaggagggggcaguccauaccgccuuggcuggagcccuagaagcagagauggauggugccaagggccggcugucuagcgggcaccucaaaugccgccugaagauggacaaacuuagacugaagggagugucauauaguuuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaauccaccgagaacagcaagaugaugcuggagcuagaucccccguucggagacucuuacaucgucauaggcgugggggaaaagaagauuacucaccacuggcaucguucaggaaguacaaucgguaaagccuuugaggcuaccguacggggcgccaagcgaauggcagugcucggggacacagcuugggauuucggaagcguuggcggugcccuuaauucccuggggaaaggcauccaccagauuuucggagcggccuuuaagucuuuguucggcgggaugucgugguuuagccaaauccugauuggaacucuccuggucuggcuuggccugaacaccaagaaugguuccauaucauugacgugucucgcuuuagggggagugcugaucuuccugaguaccgcagugucugccgacgucggcugcagcguugauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4001 - RNA, 2359 nt, Artificial Sequence
  KU681082.3 prME-long mRNA Design 1 opt
gggagaaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggaugaauaaaugcuauauucagaucauggauuuaggacacaugugugacgcaacuaugaguuacgaaugcccuaugcuggaugagggcguagaaccagacgauguggacuguuggugcaacaccacaagcaccugggucguguaugguacuugucaucacaagaaaggggaggccaggcggucccgcagagcuguuacacuaccgucucauucgaccaggaagcuccaaacgcggucacagacuuggcuggagagccgcgaauacaccaagcaccuuauucgaguggagaauuggaucuuuagaaaccccggauucgcacuggccgcugccgucauagcgugguugcucggcaguuccacaucucagaaagugaucuaucugguaaugauucugcucaucgccccugcauacagcauuaggugcaucggcguuuccaaucgggauuuuguggaagggaugucaggagguacuugggucgacgugguguuagagcauggcgggugugucaccguuauggcucaggauaagccaacaguggacauagagcugguaaccacgacugugaguaacauggccgaaguccguagcuacugcuaugaggcaucuauuuccgauauggcuucagacagccgcugucccacacaaggagaagccuaccuugacaaacagagugauacccaguaugugugcaagagaacuuugguugacaggggcugggguaauggguguggacuguucggcaaaggcucucuagugacaugcgcgaaguuugccugcuccaagaaaaugaccgggaaaagcauccagccugagaaccucgaauaccggauuaugcugucgguccacggaucucaacacuccgguaugaucgugaaugauacgggccaugagaccgacgagaaccgagcaaaaguagaaaucacaccaaauucaccccgcgcugaggccacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgcuggcgccgauacuggaacaccccauuggaacaauaaggaagcacuuguggaguuuaaagacgcccacgcuaagaggcagaccgucgugguccugggcucccaggagggggcggugcauaccgcauuggccggagcucuagaagccgagauggauggugcaaagggccggcugucuagcgggcaccucaaaugccgccugaagauggacaaacuuagacugaagggaguuucauauaguuuguguacugccgcuuucacguuuacaaaaauaccugccgaaacccuccauggcacugugaccguagagguccaguacgcagguacagacgggccaugcaaggugcccgcgcaaauggcuguugauaugcagacccugacuccugugggcagguuaaucacagccaacccagucauuacggaauccaccgagaacagcaagaugaugcuggagcuagaucccccguucggagacucuuacaucgugauaggcguaggggaaaagaagauuacucaccacuggcaucguucaggaaguacaaucgguaaagcauuugaggccaccgugcggggcgcuaagcgaauggccguucucggggacacagcaugggauuucggaagcgucggcggugcucuuaauucccuggggaaaggcauccaccagauuuucggagccgcguuuaagucuuuguucggcgggaugucgugguuuagccaaauccugauuggaacucuccugguguggcuuggccugaacaccaagaaugguuccauaucauugacgugucucgccuuagggggagugcugaucuuccugaguaccgcugucucugcagacguuggcugcagcguggauuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4002 - RNA, 2359 nt, Artificial Sequence
  KX601167.1 prME-long mRNA Design 1 opt
gggagaaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggguaaauaaaugcuauauucagaucauggauuuaggacacaugugugacgcaacuaugaguuacgaaugcccuaugcuggaugagggcguggaaccagacgaugucgacuguuggugcaacaccacaagcaccugggugguuuaugguacuugucaucacaagaaaggggaggccaggcggucccgcagagcugugacacuaccgucucauucgaccaggaagcuccaaacgcggucacagacuuggcuggagagccgcgaauacaccaagcaccuuauucgagucgagaauuggaucuuuagaaaccccggauucgcacuggccgcugccgcgauagcaugguugcucggcaguuccacaucucagaaagugaucuaucugguaaugauucugcucaucgccccugcuuacagcauuaggugcaucggcguuuccaaucgggauuuuguggaagggaugucaggagguacuugggucgacgugguguuagagcauggcgggugugucaccguuauggcccaggauaagccaacaguggacauagagcugguaaccacgacugugaguaacauggcagaaguccguagcuacugcuaugaggcuucuauuuccgauauggccucagacagccgcugucccacacaaggagaagcguaccuugacaaacagagugauacccaguaugugugcaagagaacuuugguugacaggggcugggguaauggguguggacuguucggcaaaggcucucuagugacaugcgccaaguuugcaugcuccaagaaaaugaccgggaaguccauccagccugagaaccucgaauaccggauuaugcugucgguccacggaucucaacacuccgguaugaucgugaaugauacgggccaugagaccgacgagaaccgagcuaaaguagaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgccggcgcagauacuggaacaccccauuggaacaauaaggaagcccuuguggaguuuaaagacgcucacgcgaagaggcagaccgucgugguccugggcucccaggagggggcagugcauaccgccuuggcuggagcccuagaagcagagauggauggugccaagggccggcugucuagcgggcaccucaaaugccgccugaagauggacaaacuuagacugaagggaguuucauauaguuuguguacugcugccuucacguuuacaaaaauaccugcagaaacccuccauggcacugugaccguagagguccaguacgcggguacagacgggccaugcaaggugcccgcucaaauggccguugauaugcagacccugacuccugugggcagguuaaucacagcaaacccagucauuacggaauccaccgagaacagcaagaugaugcuggagcuagaucccccguucggagacucuuacaucgugauaggcguaggggacaaaaagauuacucaccacugguaucguucaggaaguacaaucgguaaagccuuugaagcuaccgugcggggcgccaagcgaauggcaguucucggggauacagcuugggacuucggaagcgucggcggugcccugaauagccuugggaaaggcauccaucagauuuucggagcggccuuuaagucuuuguucggcgggaugucgugguuuagccaaauccugauuggaacucuccugguguggcuuggccugaacaccaagaaugguuccauaucauugacgugucucgcuuuagggggagugcugaucuuccugaguaccgcagucucugccgauguuggcugcagcguggacuuuuccaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4003 - RNA, 2359 nt, Artificial Sequence
  KX694533.2 prME-long mRNA Design 1 opt
gggagaaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcaaagccaucucauuccccaccacauuggggguaaauaagugcuauauucagaucauggauuuaggacacaugugugacgcaacuaugaguuacgagugcccuaugcuggaugaaggcguggagccagacgaugucgacuguuggugcaacaccacaagcaccugggugguuuaugguacuugucaucacaaaaagggggaagccaggcggucccgcagagcugugacacuaccgucucauucgaccaggaagcuccaaacgcggucacagacuuggcuggagagccgcgaguacaccaaacaccuuauucgagucgaaaauuggaucuuuagaaaccccggauucgcacuggccgcugccgcgauagcaugguugcucggcaguuccacaucucagaaggugaucuaucugguaaugauucugcucaucgccccugcuuacagcauuaggugcaucggcguuuccaaucgggauuuuguggaggggaugucaggagguacuugggucgacgugguguuagaacauggcgggugugucaccguuauggcccaggauaaaccaacaguggacauagagcugguaaccacgacugugaguaacauggcagagguccguagcuacugcuaugaggcuucuauuuccgauauggccucagacagccgcugucccacacaaggagaagcguaccuugacaagcagagugauacccaguaugugugcaaaagaacuuugguugacaggggcugggguaauggguguggacuguucggcaagggcucucuagugacaugcgccaaguuugcaugcuccaaaaagaugaccgggaaaagcauccagccugaaaaccucgaguaccggauuaugcugucgguccacggaucucaacacuccgguaugaucgugaaugauaucggccaugaaacggacgagaaccgagcuaagguagagauuaccccaaauucaccccgcgccgaagcuacacuugggggauucggcagucuggguuuggauugugagccuagaacugggcucgacuuuagcgaucuguauuacuuaaccaugaacaauaaacacuggcugguucauaaggaaugguuccacgacauaccacucccguggcacgccggcgcagauacaggaacuccccauuggaacaauaaagaggcccuuguggaauuuaaggacgcucacgcgaagaggcagaccgucgugguccugggcucccaggagggggcagugcauacagccuuggcuggagcccuagaggcagaaauggauggugccaaaggccggcugucuagcgggcaccucaagugccgccugaaaauggacaagcugagacugaaaggaguuucauauaguuuguguaccgcugccuucacuuuuacgaagaucccugcagagacacuccauggcaccgugacuguagaaguccaguacgcggguaccgacgggccaugcaaggugcccgcucaaauggccguugauaugcagacacugaccccugugggcagguuaauuacugcaaacccagucaucacagaguccacggaaaacagcaaaaugaugcuggagcuagaucccccguucggagacucuuacauagugauuggcguaggggacaagaaaaucacccaccacuggcaucguucaggaaguacuaucgguaaggccuuugaggcuacagugcggggcgccaaacgaauggcaguucucggggauaccgcuugggacuucggaagcgucggcggugcccuuaauucccuugggaagggcauucaccagaucuucggagcggccuuuaagucuuuguucggcgggaugucgugguuuagccaaauucugauaggaacacuccugguguggcuuggccugaacacuaaaaaugguuccaucucauugaccugucucgcuuuagggggagugcugauuuuccugaguacggcagucucugccgauguuggcugcagcguggacuuuuccaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4004 - RNA, 2359 nt, Artificial Sequence
  KY288905.1 prME-long mRNA Design 1 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugauacaggccacgaaacugacgagaaccgagccaagguagagguuaccccuaauucaccacgcgcagaagcuacacuugggggauucggcagucuggguuuggauugugagcccagaacugggcucgacuuuagcgaucuguacuauuuaaccaugaacaauaaacauuggcuggugcacaaggaaugguuccacgacauuccucucccauggcaugccggcgcugauacaggaaccccgcacuggaacaauaaagaggcccuugucgaauuuaaggacgcacaugccaagaggcagacuguggucgugcugggcucccaggagggggcuguucacacggcguuggcaggagcccuagaggcugaaauggauggugccaaaggccggcuguucucugggcaucucaagugccgccugaaaauggacaaacuuagacugaagggagugagcuacucauuguguacagcagccuuuaccuucacuaagguacccgcugagacccuccacggcacagucaccguggaaguucaguaugccgguacugacgggccuugcaaggugccagcacaaauggcggucgauaugcagacacugacgcccgugggcagguuaauaaccgcuaacccuguaaucacugagaguacagaaaacuccaaaaugaugcuggagcuagacccacccuuuggagauagcuacauugugaucggcguuggggacaagaaaauaacccaccauuggcaccguucuggaucaacaauugguaaggccuucgaggcaacuguccggggcgccaaacgaauggcugugcucggggauaccgccugggacuucggaagugugggcggugucuuuaauagccuggggaagggcauccaucagaucuucggagcagcuuuuaagucccuuuucggcgggaugucuugguuuucgcaaauuuugaucggaacgcugcucguuuggcugggccuuaacaccaaaaaugguagcauuucccugacauguuuggcccucgggggagugaugauauuccugucaacugcggugagugccgauguaggcugcucugucgacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4005 - RNA, 2359 nt, Artificial Sequence
  KF268950.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgauauaggccacgaaacggacgagaaucgagcuaaggucgaggugaccccuaacucaccacgcgccgaagcuacacuugggggauucggcagucuggguuuggauugugagcccagaacugggcucgacuuuagcgaucuguacuauuuaaccaugaauaacaaacauuggcugguacacaaggaaugguuccacgacaucccucucccauggcaugccggcgcagauacaggaacuccgcacuggaauaacaaagaggcccuuguugaauuuaaggacgcucaugcgaagaggcagaccguggucgugcugggcucccaggagggggcaguccacacagccuuggcuggagcccuagaggcagaaauggauggugccaaaggccggcuguucucugggcaucucaagugccgccugaaaauggacaaacuuagacugaagggagugagcuacucauuguguaccgcugccuuuacuuucacgaagguucccgcagagacacuccacggcaccgugacuguagaaguccaguaugcggguaccgacgggccuugcaaggugccagcucaaauggccguugauaugcagacacugacccccgugggcagguuaauuacugcaaacccugucaucacagagaguacggaaaauuccaaaaugaugcuggagcuagacccacccuuuggagauagcuacauagugauuggcguaggggacaagaaaaucacccaccauuggcaccguucuggaucaacuaucgguaaggccuucgaggcuacagugcggggcgccaaacgaauggcaguucucggggauaccgcuugggacuucggaagugucggcgguguguuuaacagccuggggaagggcgugcaucagauuuucggagccgcguuuaagucccuuuucggcgggaugucuugguuuucgcaaaucuugauuggaacacugcucgucuggcugggccuuaauacuaaaaacgguagcauaucccugaccuguuuggcccucgggggaguuaugaucuuccugucaacggcugugagugcagaugugggcugcucuguagacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4006 - RNA, 2359 nt, Artificial Sequence
  KF383121.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauauaggccacgaaaccgacgagaaccgagcaaagguggagguaacaccuaauucaccacgcgcugaagccacucuugggggauucggcagucuggguuuggauugugagcccagaaccgggcucgacuuuagcgaucuguacuauuuaacaaugaacaauaaacauuggcugguucacaaggaaugguuccacgacaucccucucccauggcaugcuggcgccgauacuggaaccccgcacuggaacaauaaagaggcacuuguggaauuuaaggacgcccaugcuaagaggcagacagucgugguccugggcucccaggagggggcggugcacaccgcauuggccggagcucuagaggccgaaauggauggugcaaaaggccggcuguucucugggcaucucaagugccgccugaaaauggacaaacuuagacugaagggaguuagcuacucauuguguacugccgcuuuuacguucacaaaggugcccgccgagacccuccacggcacuguaaccgucgaagugcaguaugcagguacagacgggccuugcaagguuccagcgcaaauggcuguggauaugcagacccugacucccgucggcagguuaauuacagccaacccugugaucacggagaguaccgaaaacuccaaaaugaugcuggagcuagacccacccuuuggagauagcuacauaguaauuggcgugggggacaagaaaaucacucaccauuggcaccguucuggaucaacaaucgguaaggcauucgaggccaccguucggggcgcuaaacgaauggccguccucggggauacagcaugggacuucggaagugugggcgguguguuuaauagccuggggaagggcauucaucagaucuucggagcugccuuuaagucccuuuucggcgggaugucuugguuuucgcaaauuuugauaggaacucugcucgucuggcugggccuuaacaccaaaaaugguagcaucucccugacguguuuggcgcucgggggaguuaugauuuuccugucaaccgccgugagugcugaugugggcugcucuguagacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4007 - RNA, 2341 nt, Artificial Sequence
  KF268949.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgaugaaaaucgagcuaaggucgaggugacgccuaacucaccacgcgccgaggcuacccuuggcggguucggaagucugggcuuggacugugaacccagaacaggucucgauuuuagcgaccuguacuauuuaacuaugaauaacaaacacuggcugguacauaaggagugguuccacgauauaccucucccauggcacgccggggcagacaccggcacaccgcauuggaauaacaaagaagcccuuguugaguuuaaggaugcucacgcgaagaggcagacuguggucgugcugggaucccaggaaggcgcaguccauaccgccuuggcuggggcccuagaggcagagauggacggagccaaaggucggcuguucucuggccaccucaagugccgccugaaaauggauaaacuuagacugaaaggggugagcuacucauuguguacagcugccuuuaccuucacuaagguucccgcagaaacgcuccauggaacagugaccguagagguccaguaugcgggcacugacgguccuugcaaggugccagcucaaauggccguugacaugcagacccugacacccguggggagguuaaucaccgcaaacccugucauuacugaaaguacagaaaauuccaaaaugaugcuggagcuagauccacccuuuggcgacagcuacaucgugauaggaguaggcgauaagaaaauuacgcaccacuggcaucguucugggucaaccaucggaaaggccuucgaggcuacugugcggggugccaaacgaauggcaguucucggcgacacagcuugggauuucgggagugucggaggcguguuuaacagccuggguaaggggauccaccagauuuucggcgccgcguuuaagucccuuuucggaggcaugucuugguuuucgcaaaucuugauugggacccugcucguguggcugggacuuaauacaaagaacggcagcauaucccugacuuguuuggcccucgguggggucaugaucuuccugucaaccgcuguuagugcagacgugggaugcucuguggauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4008 - RNA, 2359 nt, Artificial Sequence
  KU955595.1 prME-long mRNA Design 1 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugauaccggccacgaaacagacgagaaccgagcaaagguagagguuacuccuaauucaccacgcgcugaagccacccuugggggauucggcagucuggguuuggauugugagcccagaacagggcucgacuuuagcgaucuguacuauuuaacuaugaacaauaaacauuggcuggugcacaaggaaugguuccacgacauuccucucccauggcaugcuggcgccgauaccggaacaccgcacuggaacaauaaagaggcacuugucgaauuuaaggacgcccaugcuaagaggcagaccguggucgugcugggcucccaggagggggcgguucacacugcauuggccggagcucuagaggccgaaauggauggugcaaaaggccggcuguucucugggcaucucaagugccgccugaaaauggacaaacuuagacugaagggagugagcuacucauuguguacggccgcuuuuacauucaccaagguacccgccgagacucuccacggcaccgucacaguggaaguucaguaugcagguaccgacgggccuugcaaggugccagcgcaaauggcugucgauaugcagacucugacacccgugggcagguuaauaacggccaacccuguaaucaccgagaguacugaaaacuccaaaaugaugcuggagcuagacccacccuuuggagauagcuacauugugaucggcguuggggacaagaaaauaacacaccauuggcaccguucuggaucaaccauugguaaggcauucgaggccacaguccggggcgcuaaacgaauggccgugcucggggauacugcaugggacuucggaagugugggcggugucuuuaauagccuggggaagggcauccaucagaucuucggagcugccuuuaagucccuuuucggcgggaugucuugguuuucgcaaauuuugaucggaacccugcucguuuggcugggccuuaacacgaaaaaugguagcauuucccugaccuguuuggcgcucgggggagugaugauauuccugucaacagccgugagugcugauguaggcugcucugucgacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4009 - RNA, 2359 nt, Artificial Sequence
  KF383116.1 prME-long mRNA Design 1 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaacacaagaaaggggaagcacggcgcuccagaagggccgugacacuaccaucucauucgacccggaagcuccagacgcgcucacagacuuggcuggagagccgagaguauaccaagcaccuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacauggcgggugugucaccguuauggcccaagauaaaccuacaguggacauugagcugguaaccacgacugugaguaacauggcagagguccguagcuacugcuacgaggcuucuaucuccgauauggccucagacagccgcuguccaacacagggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucaacccgaaaaccucgaguaucggaucaugcugucgguccacggaucucagcacuccgguaugaucgugaaugauauuggccaugaaaccgacgagaaccgagcaaagguagagguuacaccuaauucaccacgcgcugaagccacucuugggggauucggcagucuggguuuggauugugagcccagaaccgggcucgacuuuagcgaucuguacuauuuaacaaugaacaauaaacacuggcuggugcauaaggaaugguuccacgacauaccucucccauggcacgcuggcgccgauacuggaaccccgcauuggaacaauaaagaggcacuugucgaauuuaaggacgcccacgcuaagaggcagacaguggucgugcugggcucccaggagggggcgguucauaccgcauuggccggagcucuagaggccgaaauggauggugcaaaaggccggcuguucucugggcaccucaagugccgccugaaaauggacaaacuuagacugaagggagugagcuacucauuguguacugccguaugcacggcugccaagguccccgcagagacacuccauggcaccgugacuguugaagugcaauaugcggguaccgacgggccuuguaaggucccagcucagauggccguggauaugcagacacugacccccguaggcagguuaaucacugcaaacccugugauuacagagaguacggaaaacuccaaaaugaugcuggagcuagacccacccuuuggagauagcuacaucguuauaggcgucggggacaagaaaauuacccaccacuggcaucguucuggaucaacuaucgguaaggccuucgaggcuacagugcggggcgccaaacgaauggcagugcucggggauaccgcuugggacuuuggaagugucggcgguguuuucaauagccuggggaagggcauccaccaaauuuucggagccgcguuuaagucccuuuucggcgggaugucuugguuuucgcagaucuugauuggaacacugcucguguggcugggccuuaacacuaaaaaugguagcauaucccugaccugcuuggcccucgggggagugaugaucuuccugucaacggcuguaagugcagaugucggcuguucuguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4010 - RNA, 2341 nt, Artificial Sequence
  KU963574.2 prME-long mRNA Design 1 opt
gggagaaagcuuaccaugagaaucauuaacgccaggaaggagcggaaacgccgaggcgcugacgcaagcauagggaucgugucccugcuccuuaccacagucauggccgcggaaauuacucguagaggaucugcuuacuauauguaccuggauaggucagacgccgguaaggcaaucaguuucguuacgaccuugggcgugaauaaaugccacguacagauuauggauuuagggcauaugugugacgccacaaugagcuaugagugccccaugcuggaugaaggaguggagccugacgaugucgacuguuggugcaacacuaccuccacaugggugguuuacggcaccugucaccauaagaaaggugaagcucggcgcucuagaagggcagugacucuaccaucgcacucaacacggaagcuccaaacccgcagccagacguggcuggagagucgagaguauacuaagcaucuuaucaaagucgaaaauuggauauuuagaaacccgggguucgcccugguggcuguagccaucgcgugguugcucggauccucuaccagccagaagguuauuuaccuggugaugauccugcucauugcacccgccuauuccaucaggugcauaggcgucucaaaucgggauuuuguggagggcaugagugggggaacauggguggacgucguuuuagaacacgguggcugugugacuguaauggcucaggauaaaccuaccguggacauugagcuggucacaaccacggugagcaacauggccgagguucguucuuacugcuacgaagcauccaucucagauauggcuagcgacagucgcuguccaacucaaggggaggccuaucuugacaagcagucugauacacaguacgugugcaaaagaaccuuggucgacaggggauggggcaaugguugugggcuguucggaaagggcucccuagugacuugcgcgaaguuuacaugcagcaaaaagaugaccggcaaaucgauucagcccgaaaaccucgaguaucggaucaugcugucuguacacgggucccaacauucaggaaugaucguuaaugaugaaaaccgagccaagguggaggucacgccuaauaguccacgcgcagaggcuacccuugguggcuucgggagccugggauuggacugugaacccagaacaggccucgauuuuuccgaccuguacuauuuaacuaugaacaauaaacacuggcuggugcauaaggagugguuccacgauauuccucucccauggcacucuggugccgacaccgaaacaccgcauuggaacaauaaagaggcucuugucgaauuuaaggaugcccacgcaaagaggcagacugugguugugcuggggagccaggagggcgccguacauaccgcuuuggcgggagcacuagaggccgaaauggacggcgcuaaagggcggcugucaaguggacaccucaagugccgccugaaaauggauaaacuuagacugaaaggugucuccuacagcuuguguacagccgcauucaccuuuacuaaggugcccgccgagacgcuccauggcacaguuaccguggaaguccaguaugcugggagggacggaccuugcaaggugccagcccaaauggcaguagacaugcagacucugacccccgugggccguuuaauaacagcgaacccuguuaucaccgagucuacugaaaacucaaaaaugaugcuggagcuagauccacccuucggugacaguuacauugucaucggggugggcgauaagaaaauaacacaccacuggcaucggagcggauccauuaucggcaaggcuuuugaggccacggugcgaggggcaaaaagaauggccguccucggagacaccgcuugggauuucgguucuguuggcgggguguucaauucgcugggaaagggcauccaccagauuuuuggugccgcauucaagagccuuuuugggggcauguccugguucucacaaaucuugauuggaacucugcucguguggcugggccuuaacacaaagaaugggaguauaucucugaccuguuuggcucucggaggcguaaugaucuuucugagcacagccgucuccgcggacguggguugcucaguugauuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4011 - RNA, 2341 nt, Artificial Sequence
  KX601166.1 prME-long mRNA Design 1 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugaugaaaaccgagcaaagguagagguuaccccuaauucaccacgcgcugaggccacacuuggcggguucggaagucugggcuuggacugugaacccagaacuggucucgauuuuagcgaccuguacuauuuaaccaugaacaauaaacacuggcuggugcauaaggagugguuccacgauauuccucucccauggcacgcuggggccgacacaggcacuccgcauuggaacaauaaagaagcacuugucgaguuuaaggaugcccacgcuaagaggcagaccguggucgugcugggaucccaggaaggcgcgguucauacagcauuggccggggcucuagaggccgagauggacggagcaaaaggucggcuguucucuggccaccucaagugccgccugaaaauggauaaacuuagacugaagggggugagcuacucauuguguaccgccgcuuuuacuuucacgaagguacccgccgaaacacuccauggaaccgucacuguggagguucaguaugcaggcaccgacgguccuugcaaggugccagcgcaaauggcugucgacaugcagacacugacccccguggggagguuaauaacugccaacccuguaaucacagaaaguacggagaacuccaaaaugaugcuggaacuagauccacccuuuggcgacagcuacauugugaucggaguuggcgauaagaaaauaacccaccacuggcaucguucugggucaacuauuggaaaggcauucgaggccacaguccggggugcuaaacgaauggccgugcucggcgacaccgcaugggauuucgggagugugggaggcgucuuuaauagccuggguaaggggauccaccagaucuucggcgcugccuuuaagucccuuuucggaggcaugucuugguuuucgcaaauuuugaucgggacacugcucguuuggcugggacuuaacacuaaaaauggcagcauuucccugaccuguuuggcgcucgguggggugaugauauuccugucaacggccgugagugcugacguaggaugcucugucgauuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4012 - RNA, 2359 nt, Artificial Sequence
  KF383118.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaaacacggcgcuccagaaggucugucucgcuacgguaucacuacacccgcaagcuccaaacgcgaucacagacuuggcuggagagcagagaguauaagaaacaucuuauaaugguggaaaauuggaucuuuaggaacccaggauucgcaauuguuaguguggccaucaccuggcugaugggcuccuugacaucucagaaggucauuuaccucgugaugaucguacugauaguuccggcuuacagcauuuccugcaucggcgugucaaaucgggaucuggucgaggggaugaguggagguacuuggguggacgugguccucgaacacggcggguguguuaccgagauggcccaggauaaacccacaguggacauugaguuaguaaccaugacggugagcaacauggcggaaguccguucuuauugcuacgaggcaucccugucagauauggccagcgcuagucgcuguccuacucaaggagaaccaucucuugacaagcaguccgacacacagagcgugugcaaaagaaccuugggcgauagggguugggggaauggauguggcaucuuuggcaaggggucgcugguuacuugcucuaaguucacaugcuguaaaaagaugcccggaaaauccauccagccugagaaccuagaauaucggauuaugcucccagugcacgguucacaacauaguggcaugauagucaaugacaucgggcacgagaccgaugagaaccgagccaagguggaaguaacgcccaauagcccucgcgcagaggcuacccugggaggcuuugguucccuugggcuggacugcgaaccaagaacaggcuuggauuucucugaccucuacuaucugacuaugaacaauaaacauugguuaguucacaaggagugguuucacgauauuccgcugcccuggcaugccggagcggacaccggcacaccucacuggaacaauaaagaagcccucguggaguucaaggaugcacaugcuaagaggcagacugucgugguccuugggagccaggagggagccgugcacaccgcucuggccggugcauuggaagccgagauggacggcgcuaaagggcggcuauuuucaggacaucugaagugucgccucaaaauggauaagcugagacuuaaaggcguuaguuacucccugugcacagcggcauucaccuuuacuaaggugccagccgaaacguugcacgguacaguaaccgucgaggugcagagcgcugggacugacggccccuguaagguuccugcccaaauggcaguggacaugcagacccucacaccagucggaaggcugaucaccgccaaccccgugauaacugaaucuacagagaacucaaaaaugauguuagagcuggauccgccuuucggcgacaguuauauuguaaucggggugggagauaagaaaaucacgcaccauuggcaccguagcgguuccaccauuggcaaggcuuuugaagccacuguucgaggggcaaaacggauggcgguccuaggagacacagcuugggauuucggcucugugggugggguguucaauucgcucggcaagggaauccaucagauuuuuggcgccgcauucaagagccuguuugggggaauguccugguucucacaaauacuuaucggcaccuugcuggucuggcucggucugaacacuaaaaaugggaguauuucucuuacaugccuggccuugggaggcguuaugaucuuucucagcaccgcuguguccgccgacguggguuguucaguagauuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4013 - RNA, 2353 nt, Artificial Sequence
  KF383120.1 prME-long mRNA Design 1 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacaaugggggugaauaaaugccacguccagaucauggauuugggacauaugugugacgcuacuaugaguuaugagugccccauguuagaugaaggcguugagccugacgauguggacuguuggugcaacaccacaagcaccuggguaguguacgguacuugucaccauaagaaaggggaagcacggccaucccgcagagccgucacacugccgucucacucgaccaggaagcuacaaacgcggucacagacuuggcucgagagccgcgaguauaccaagcaucugauaaaaguggaaaauuggauccuucgaaaccccggauuuacaguugcugcccuggcgauggcaugguugcucggcaauaguacuucccagagagugauuuaccuggucaugauccugcucauugccccugcuuauucuaucaggugcauaggcgugagcaaccgggauuucguagaggggauguccggagguaccuggguugacguggucuuagaacacggcgggugugugacagugauggcccaggauaagccaaccgucgacauugagcugguuacgacuacagugucaaauauggcagagguacguaguuacugcuacgaagcuagcaucucugauauggccuccgacucacgcugucccacccaaggagaggcguaucuugacaaacagagcgauacucaguacgugugcaagagaacauuggucgacaggggcugggguaacggguguggacuguuuggcaaaggcagucuagugaccugcgccaaguucacgugcucuaagaaaaugaccgggaaguccauucagccugaaaaucucgaguaucggaucaugcugagcguucacggaucgcaacauucugguaugaucgugaacgauauuggccacgaaacagacgagaaucgagcaaaagucgaggugacuccaaacucaccccgcgcugaagccacccuugggggauuuggcucccuggguuuggauugugagccuagaacagggcucgacuucagugaucuguacuauuuaacuaugaauaacaagcauuggcugguacacaaagaaugguuucacgacauaccacucccguggcaugcuggcgccgauaccggaacaccccacuggaauaacaaggaggcacuuguugaguucaaagacgcccaugcuaagaggcagaccguggucgugcugggcagccaggaaggggcgguccacacugcauuggccggagcucuagaggccgaaauggauggugcaaagggccggcuguuuuccgggcaucucaaaugccgcaucaagauggacaaacugagacuuaagggagugucuuacagccuguguacggccgcuuucacauuuucaaaaguuccugccgagaccuugcacggcacugugaccguagaaguccaguaugcagguagggacgggccaugcaaggugcccgcgcaaauggcuguugauaugcagacacucaccccugugggccgucugauuacugccaacccaaucauaacagagaguacggaaaauucccggaugauguuagagcuggaucccccguucggagacagcuacauugucaucggcgugggggacaagaaaaucacccaccauuggcaccgaucuggaucaacuauugguaaggcauuugaggccacaguaagaggcgcuaaaaggauggccgugcuaggggauaccgcaugggacuucggaaguguuggcggugucuucaacagccucgggaagggcgugcaucagguguuuggagcugccuucaaaucccuguuuggcgggaugucuugguucucgcaaauccuuauuggaacauugcuggucuggcucggccugaauacuaagaacgguagcauaucccuugcgugucuggcccucgggggagcuaugaucuuuuugucaaccgcaguuagugccgaugugggcugcucuguggacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4014 - RNA, 2284 nt, Artificial Sequence; identical to SEQ ID NO: 3849
  KU321639.1 prME-short mRNA Design 1 opt

SEQ ID NO: 4015 - RNA, 2284 nt, Artificial Sequence; identical to SEQ ID NO: 3850
  KU312312.1 prME-short mRNA Design 1 opt

SEQ ID NO: 4016 - RNA, 2272 nt, Artificial Sequence; identical to SEQ ID NO: 3851
  AY632535.2 prME-short mRNA Design 1 opt

SEQ ID NO: 4017 - RNA, 2284 nt, Artificial Sequence; identical to SEQ ID NO: 3852
  KU527068.1 prME-short mRNA Design 1 opt

SEQ ID NO: 4018 - RNA, 2284 nt, Artificial Sequence
  KX421193.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaccgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4019 - RNA, 2284 nt, Artificial Sequence
  KX377335.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccgcaagaaaggugaggcccgacguuccagaagggcugucacacuaccaucucauucgacccggaagcuccaaacgcgcucacagacuuggcuggaaagcagagaguauaccaaacaccuuauuaagguggagaacuggaucuuuaggaauccgggguucgcacugguugccguggcuauagccugguugcucggaaguuccacaucucagaaggucaucuaccuggugaugauucugcucaucgcgcccgcauauagcauucggugcaucggcguauccaaccgcgacuuuguugaaggcaugucagggggaacuuggguggaugucguguuagagcaugguggcugugugaccgucauggcccaggacaaaccuacaguugauauagaacuggugaccacgacuguaaguaauauggcugaggugcgaagcuacugcuacgaggccucuauuuccgacauggcaucagauagcagauguccaacacaaggggaggcuuaucuugacaagcagagugacacccaguacgucugcaaaaggacuuugguggaucggggauggggcaacgguugugggcuguucggaaagggcucucuaguuacaugcgccaaauuuaccugcuccaagaagaugacgggcaaaagcauccagcccgaaaaucucgaauaucguauuaugcugucggugcacgggucucaacacuccggaaugaucgucaacgacaccgguuacgagacagaugaaaaucgcgcgaagguggagguaacuccuaacucaccaagagccgaggcaacccuuggcggguucggaagucugggcuuggacugugaacccaggacaggucucgauuuuagcgaccuguauuacuuaacuaugaauaacaaacauuggcugguucacaaggagugguuccaugauaucccucucccauggcacgcuggggccgacaccggcacaccgcacuggaauaacaaagaagcucuuguggaguuuaaggaugcccaugcaaaacggcagaccgucgugguccugggaucccaggaaggcgccgugcacacugcuuuggcgggggcacuagaggccgagauggacggagcuaaggguaagcuguucucuggccaucucaaaugccgacugaagauggauaaacuucgccugaaggggguuagcuauucauuguguacggccgcauuuacauucaccaaagugcccgccgaaacucuccacggaaccguaacagucgaggugcaguacgcuggcaccgacgguccuugcaagauuccaguucaaauggccguggacaugcagacucugacacccgucgggagauuaauaacggcaaauccugugaucaccgaaaguacugagaacuccaagaugaugcuggaacuagauccacccuuuggcgacagcuacauuguaaucggagugggcgauaaaaagauaacacaucacuggcacaggucugggucaaccauuggaaaagcguucgaggcuacaguucggggugccaagcgcauggcaguccucggcgacacugccugggauuucgggagugugggaggcguguuuaacagccuggguaaagggauccaucagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4020 - RNA, 2284 nt, Artificial Sequence
  LC002520.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaccgucaacgacaucgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4021 - RNA, 2266 nt, Artificial Sequence
  DQ859059.1 prME-short mRNA Design 1 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacgagaaucgugccaagguagaaguuacaccuaacucaccacgcgcggaggccacucuugguggcuucgggagucugggauuggauugugagcccagaaccggccucgacuuuagcgaucuguacuauuuaacaaugaauaacaaacacuggcuggugcauaaggaaugguuccacgacaucccucucccauggcacgcaggggcugauacugggaccccgcauuggaauaacaaagaggcccuugucgaauuuaaggacgcucacgccaaaaggcagacaguggucgugcugggcucccaggagggagcaguucauaccgccuuggcuggcgcgcuagaagcagagauggauggggccaagggacggcuguucucuggucaccucaagugccgacugaaaauggacaaacuucgccugaagggcgugagcuacucauuguguacugcugccuuuacguucacaaagguacccgcagagacccuccaugggacugucaccguggaaguucaguaugccggaacagauggcccuugcaaagugccagcucaaauggccgucgacaugcagacccugacucccguggguagauuaaucacagcaaauccuguaauuacggagaguaccgaaaacuccaagaugaugcuggagcuagacccacccuuuggggauagcuacauagugaucggcguuggagacaagaaaauuacucaccacuggcauaggucuggcucaacaaucgggaaggcguucgaagcuaccguccggggagccaaacgcauggcagugcucggugauacagccugggacuucggcaguguggguggagucuuuaacagccugggcaaggguauacaccagauuuucggggcugccuuuaaaucccuuuucggcggaaugucuugguuuucgcaaaucuugaucggcacucugcucguuuggcuggggcuuaauaccaagaacggaagcauuucccugacguguuuggcacucggcggugugaugaucuuccugucaaccgcugugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4022 - RNA, 2272 nt, Artificial Sequence
  KU963573.2 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgagaaucucgaauaucggauuaugcugucggugcacgggucucaacauuccggaaugaucgguuacgagaccgacgaaaaccgugcgaaggucgaggugacaccuaauucaccacgcgccgaggcaacucuuggcggguucggaagucugggcuuggauugugaacccagaaccggucucgacuuuagcgaucuguauuacuuaacaaugaacaauaaacacuggcugguacauaaggagugguuccacgacaucccucucccauggcacgcuggggccgauacuggcaccccgcauuggaacaauaaagaagcucuuguugaguuuaaggacgcccacgcaaaaaggcagacaguggucgugcugggaucccaggaaggcgccguccauaccgcuuuggcgggggcacuagaggccgagauggauggagcuaaggguaagcuguucucuggccaccucaaaugccggcugaagauggacaaacuucgacugaagggggugagcuauucauuguguacugccgcauuuacguucacaaaaguucccgccgaaacccuccauggaacugugaccguagagguccaguacgcuggcacagaugguccuugcaagauuccagugcaaauggccguugacaugcagacccugacucccguggggcgcuuaauaacagcaaacccugucaucacggaaaguaccgaaaauuccaagaugaugcuggaacuagacccacccuuuggcgauagcuacauugugaucggaguaggcgacaaaaagauaacucaccacuggcauagaucugggucaacaauuggaaaagcguucgaggcuaccgugaggggugccaagcggauggcaguucucggcgauacagccugggacuucgggagugucggaggcguguuuaacagccuggguaaagggauccaccagaucuucggcgcugccuuuaagucccuuuucggaggcaugucuugguuuucgcaaauuuugaucgggacucugcucguguggcugggacuuaacaccaagaauggcagcauuucccugacguguuuggcacucgguggggucaugauauuccugucaaccgcuguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4023 - RNA, 2284 nt, Artificial Sequence
  KX694534.2 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguagggggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4024 - RNA, 2284 nt, Artificial Sequence
  KX369547.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccgggcuggcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggagucggcgagaaaaagaucacucaccacuggcaucggucugggucaacaauaggaaaggcauucgaagccaccgugcgcggugcuaaaagaauggccguacugggcgauacagcaugggacuuugggagugugggaggcgcucuuaauagcuuggguaaggggauucaccagaucuucggcgccgcguucaaaucccuguuuggaggcaugucuugguucucgcaaauccucauugggacucugcuuauguggcugggauugaacaccaagaauggcagcaucucccucaugugucuggccuuaggugggguucugauuuuucuaucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4025 - RNA, 2284 nt, Artificial Sequence
  KX447515.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacugguaucggucugggucaacaauaggaaaggcauuugaagccaccgugcgcggugcuaaaagaauggccguacucggcgauacagcaugggacuucgggagugugggaggcgcucugaauagccuugguaaggggauucaucagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4026 - RNA, 2284 nt, Artificial Sequence
  KU729218.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacacccagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4027 - RNA, 2284 nt, Artificial Sequence
  KU501217.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagauccgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4028 - RNA, 2284 nt, Artificial Sequence
  KU312314.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacuggcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4029 - RNA, 2284 nt, Artificial Sequence
  KX446950.2 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuacccuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4030 - RNA, 2284 nt, Artificial Sequence
  KY003157.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggucgugagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4031 - RNA, 2284 nt, Artificial Sequence
  KX811222.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaagugcauggguggucuauggcaccugucaucacaaaaagggugaagcccgccgaagccguagagcugugacucuaccgucccauucuacaaggaaacuccaaacccggccccagacguggcuggagucgcgcgaguacacuaagcaccuuauuagaguugaaaauuggaucuuuaggaacccuggguucgcacuggccgcugccgcgauugcaugguugcucggaucaagcaccagucagaaagugaucuaucuggucaugauacugcucaucgccccagcuuacuccauucggugcaucggcgugucuaaucgcgacuuuguagagggcaugagcgggggaacauggguugauguggucuuagaacaugguggcugugugacugugauggcccaggacaagcccaccgucgauauugagcugguuacaaccacgguguccaacauggcagagguacgaucauacugcuaugaagcuaguaucagcgacauggccucugauuccagauguccuacucaaggggaggcguaccuugacaagcagucagacacacaguaugugugcaaaaggaccuuggucgaucggggauggggcaaugguugugggcuguucggaaagggcagccuagugacuugcgccaaauuugcaugcaguaagaaaaugacaggcaagucuauacagccagaaaaccucgaguaccguauuaugcuguccguucacgggagccaacacucgggaaugaucgugaaugacaccggucaugaaacggaugagaaccgcgcuaaggucgagauuacccccaauucuccuagagccgaagcuacacuuggcggguucggaucccugggcuuggacugugagccaaggacuggucucgauuuuucagaccuguauuacuuaaccaugaacaauaaacacuggcuggugcauaaggaaugguuccacgauaucccgcuccccuggcacgccggggcagacacaggcacuccucauuggaacaauaaagaggcccuuguagaauuuaaggaugcucacgcgaaacggcagaccguugugguccugggaagucaggagggcgcagugcauacagccuuggcuggggcccuagaggcagaaauggacggagccaagggucgacugagcuccggccaccucaaaugccgccugaagauggauaaacuuagacugaaaggggucucuuauagcuuguguaccgcugccuucacuuuuacgaagaucccagcagagacacuccauggaaccgugacuguugaagugcaguacgcgggcaccgacggucccugcaaaguaccugcucaaauggccgucgacaugcagacacugaccccaguggggagguuaauuacugcaaaccccguuauaacagagucaacggaaaacaguaagaugaugcuggagcuagauccgccuuucggcgacuccuacaucgugauuggagucggcgagaaaaagaucacccaccacuggcaucggagcgggucuacuauaggaaaggccuuugaagcuacagugcgcggugccaaaagaauggcaguacucggcgauaccgcuugggacuucgggucagugggaggcgcccugaauagucuugguaaggggauucaccagaucuucggcgcggccuuuaagagcuuguucggaggcauguccugguuuucucaaauccugauugggacacuccugauguggcuuggacugaacacuaagaauggcucgaucagcuugaugugucucgcucugggugggguuuuaauuuuccuguccaccgcagucucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4032 - RNA, 2284 nt, Artificial Sequence
  KX447516.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacauccaaaaaggugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacagggggaggccuaccuugacaaacaaagcgacacccaguaugugugcaagaggacuuuggucgaucggggauggggcaaugguugugggcuguucggaaaaggcagucuagugacaugcgcgaaguuugccugcucuaaaaagaugaccggcaaguccauacagccugaaaaccucgaguaccguauuaugcugagcguucacgggucgcagcacucuggaaugaucgugaaugacacgggucaugaaaccgaugagaaccgcgcaaaagucgagauuacaccaaauucccccagagcugaagccacucuuggcggguucggaucacugggcuuggacugugagccuaggaccggucucgauuuuagugaccuguauuacuuaacaaugaacaauaagcacuggcuggugcauaaagaaugguuccacgauaucccacucccguggcacgcuggggccgacacuggcaccccucauuggaacaauaaggaggcacuuguagaauuuaaagaugcccacgcuaagcggcaaacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcagauggcugucgacaugcaaacccugacuccuguggggagguuaauuacagccaacccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaauagccuugguaaagggauucaccagaucuucggcgccgcguuuaaguccuuguucggaggcaugucuugguuuucgcagauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4033 - RNA, 2284 nt, Artificial Sequence
  KX520666.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacacggcagaaagugaucuaucuggucaugauacugcucaucgcacccgccuacuccauucgcugcaucggcgugucuaaucgagacuuuguagagggcaugagcgggggaacuuggguugauguggucuuagaacaugguggcugugugaccgugauggcucaggacaagccaacagucgauauugagcugguuaccacgacuguguccaacauggccgagguaagaucauacugcuaugaagcaaguaucagcgacauggcuucugauuccaggugucccacacaaggggaggccuaccuugacaagcagucagacacccaguaugugugcaaacggacuuuggucgaucguggauggggcaaugguugugggcuguucggaaagggcagccuagugacaugcgcgaaauuugccugcaguaagaaaaugaccggcaagucuauacagccugaaaaccucgaguaccgcauuaugcuguccguucacgggagccaacacucgggaaugaucgugaaugacacgggucaugaaaccgaugagaacagagcaaaggucgagauuacaccaaauucucccagggcugaagccacucuuggcggguucggaucccugggcuuggacugugagccucggaccggucucgauuuuucagaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacgacagacaguugugguccugggaagucaggagggcgcggugcauaccgcauuggccggggcucuagaggccgaaauggacggagcaaagggucgccugagcuccggccaccucaaaugcagacugaagauggauaaacuuaggcugaaaggggucucuuauagcuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggcgguuaauuacagccaacccaguuauaacggagucaaccgaaaacaguaagaugaugcuggagcuagaucccccguucggcgacuccuacaucgugauuggagucggcgagaaaaagaucacucaccacuggcaucgcagcgggucuacaauaggaaaggcauuugaagccaccgugagaggugcuaaaaggauggccguacucggcgauacagcaugggacuucgggucagugggaggcgcucugaauagucuugguaaggggauucaccagaucuucggcgccgcguuuaagagcuuguucggaggcauguccugguuuucucaaauccugauugggacucuccugauguggcuuggacugaacaccaagaauggcucgaucagcuugaugugucucgcccugggugggguuuuaauuuuccuguccacggcugucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4034 - RNA, 2284 nt, Artificial Sequence
  KU497555.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaacccaggagggcgcggugcauacugcauuggccggggcucuagaggccgaaauggacggagcaaagggucgacugagcuccggccaccucaaaugccgccugaagauggauaaacuuagacugaaaggggucucuuauagcuuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagucaacugaaaacaguaagaugaugcuggagcuagaucccccguucggcgacuccuacaucgugauuggagucggcgagaaaaagaucacacaccacuggcaucggagcgggucuaccauaggaaaggcauuugaagccacagugcgcggugcuaaaagaauggccguacucggcgauacugcaugggacuucgggucagugggaggcgcucugaauagucuugguaaggggauucaccagaucuucggcgccgcguuuaagagcuuguucggaggcauguccugguuuucucaaauccugauugggacccuccugauguggcuuggacugaacacgaagaauggcucgaucagcuugaugugucucgcccugggugggguuuuaauuuuccuguccaccgcugucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4035 - RNA, 2284 nt, Artificial Sequence
  KY075939.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuuuacggugcauuggcgugagcaaucgcgacuuuguagagggcauguccgggggaacuuggguugaugugguccuggaacaugguggcugugugaccgugauggcucaggacaagccaacagucgauaucgagcuuguuaccacgacugugucaaacauggccgagguacgaaguuacugcuaugaagcaagcauuucugacauggcuuccgauucaagaugucccacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauccagccugaaaaccuggaguaccguauaaugcuuagcguucacgggucgcaacacucuggaaugauugugaaugacacgggucaugaaaccgaugagaaccgcgcaaaggucgagaucacaccaaauucccccagagcugaagccacucugggcggguucggaucauugggccucgacugugagccuaggaccggucuggauuuuagugacuuauauuaccugacaaugaacaauaaacacuggcucgugcauaaggaaugguuccacgauauuccacuuccguggcacgcuggggccgacacuggcaccccucauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagaucccugccgagacccugcauggaacugugaccguugaagugcaguacgcaggcacagacgguccaugcaaaguacccgcgcaaauggcugucgacaugcagaccuuaacuccuguggggaggcugaucacagccaacccaguuauuacggagaguaccgaaaacuccaagaugaugcuagagcucgaucccccguucggcgacagcuacauagugaucggagucggcgagaaaaagauuacucaccacuggcaucggucugggucaacaaucggaaaggcauuugaagccaccgugcgcggugcuaaaagaauggccguacugggcgauacagcaugggacuucgggagugugggaggcgcucuuaauagcuuggguaaggggauacaccagauuuucggcgccgcguuuaaaucccuguucggaggcaugucuugguuuucgcaaauccucaucgggacucugcuuauguggcugggauugaacaccaagaauggcagcauuucccucaugugucuggccuuaggugggguucugaucuuccuaucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4036 - RNA, 2284 nt, Artificial Sequence
  KY075932.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaaucgaaaauuggauuuuuaggaaccccggguucgcucuggcagccgcugccaucgcgugguugcucggaagcaguacaucccagaaaguuauauaucuggugaugauccugcucauugcacccgccuacucuauccggugcauuggcgucagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4037 - RNA, 2284 nt, Artificial Sequence
  KU870645.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauccugaggaaccccggguuugcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggaaucggcgagaaaaagauaacucaccacuggcaucggucugggucaacaauuggaaaggcauucgaagccaccguccgcggugcuaaaagaauggccgugcugggcgauacagcaugggacuuugggaguguaggaggcgcucuuaauagcuuggguaaggggauccaccagaucuucggcgccgcguucaaaucccuguuuggaggcaugucuugguucucgcaaauucucaucgggacucugcuuauguggcugggauugaacaccaagaauggcagcauuucccucaugugucuggccuuagguggggugcugauauuucuaucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4038 - RNA, 2284 nt, Artificial Sequence
  KU729217.2 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuucaaccacggugaguaacauggccgagguacgaagcuacugcuaugaagcaacuaucucugacauagcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacagcgguugugcugggaagccaggagggcgcaguccauaccgccuuggcuggggcccuagaggcagaaauggacggagccaagggucgacuguccucuggccaccucaaaugccgccugaagauggauaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagacaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4039 - RNA, 2284 nt, Artificial Sequence
  KX087101.3 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaacugcaguacgcaggcacagacgguccaugcaaagugcccgcgcaaauggcuguagacaugcagaccuuaacuccugucgggaggcugauuacagccaacccagugauaacggagaguaccgaaaacuccaagaugaugcuagagcucgaucccccguucggcgacagcuacaucguuauuggagugggcgagaaaaagaucacucaccacuggcaucggucugggucaacaauaggaaaggcauuugaagccaccguccgcggugcuaaaagaauggccgugcugggcgauacagcaugggacuucgggaguguaggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuagguggggugcugauuuuccuaucaacggcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4040 - RNA, 2284 nt, Artificial Sequence
  KY014317.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaucgaaaacuccaagaugaugcuggagcuagaucccccguucggcgacagcuacauugugaucggagucggcgagaaaaagauaacccaccacuggcaucggucugggucaacuauuggaaaggcauuugaagccacagugcgcggugcuaaaagaauggccguacucggcgauaccgcaugggacuucgggagugugggaggcgcucugaauagccuugguaaggggauccaccagaucuucggcgccgcguuuaaauccuuguucggaggcaugucuugguuuucgcaaauucugaucgggacacuccugauguggcuuggacugaacacuaagaauggcagcauuuccuugaugugucucgcccugggugggguuuuaauauuccugucaaccgcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4041 - RNA, 2284 nt, Artificial Sequence
  KU758876.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagucaagggucgacuguccucuggccaccucaaaugccgccugaagauggauaaguuaagacugaaaggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuucauguguuuggcgcucggugggguccugauuuuucuuucaacggccgugagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4042 - RNA, 2284 nt, Artificial Sequence
  KU758874.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaaggguaaacuguccucuggccaccucaagugccgacugaagauggauaaacuucgccugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagauuaauuacagccaacccaguuauaacggagaguaccgaaaacuccaaaaugaugcuggagcuagaucccccguucggcgacagcuacaucgugauuggagucggcgagaagaagaucacucaccacuggcauaggucugggucaacaauaggaaaagcauuugaagccaccgugcggggugcuaagcgcauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4043 - RNA, 2284 nt, Artificial Sequence
  KY317939.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaaggaugcgggugaagcuauuucuuuccccaccacauugggcaugaacaaaugcuauauacagaucauggacuuagggcacaugugugaugccacuaugucauacgagugcccuaugcuggacgaaggaguggagccagaugacguagauuguuggugcaauaccacaaguaccuggguggucuauggcacuugucaucacaagaaaggugaagcacgccgaagccguagagccgugacacuaccgucccauucuaccaggaagcuccaaacgcggucgcagacuuggcuggagucacgcgaguacaccaaacaccuuauuagaguugaaaacuggaucuuuaggaaucccggguucgcucuggcagccgcugccauugcgugguugcucggaagcaguacaucccagaaggugaucuaucuggucaugauacugcucaucgcacccgccuacucuauucggugcaucggcgugagcaaccgcgacuuuguagagggcauguccgggggaacuuggguugauguggucuuagaacaugguggcugugugaccgugauggcucaggacaagccaacagucgauauugagcugguuaccacgacugugucaaauauggccgagguacgaaguuacugcuaugaagcaagcaucucugacauggcuuccgauucaagaugucccacacaaggggaggccuaccuugacaaacagagcgacacccaguaugugugcaagaggacuuuggucgaucggggauggggcaacgguugugggcuguucggaaaaggcagucuagugacaugcgcgaaguuugccugcucuaaaaagaugaccggcaaguccauacagccugaaaaucucgaguaccguauuaugcugagcguucacgggucgcaacacucuggaaugaucgugaacgacacgggucaugaaaccgaugagaaucgcgcaaaagucgagauuacaccaaacucccccagagcugaagccacucuuggcggguucggaucacugggcuuggacugugagccuaggaccggucucgauuuuagugaccuguauuacuuaacaaugaauaacaagcacuggcuggugcauaaagaaugguuccacgauaucccacucccguggcacgcuggggccgacacuggcaccccucauuggaauaacaaggaggcacuuguagaauuuaaagaugcccacgcuaagcggcagacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagguuaauuacagccaauccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaacagccuugguaaagggauucaccagaucuucggcgccgcguuuaaguccuuguucggaggcaugucuugguuuucgcaaauccugauugggacucuccugauguggcuuggacugaauaccaaaaacggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4044 - RNA, 2284 nt, Artificial Sequence
  KY014314.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaggcccacgcuaaacggcagacaguugugguccugggaagccaggagggcgcggugcauaccgcauuggccggggcucuagaagccgagauggauggagcaaagggucgacuguccucuggccaccucaaaugccgccugaagauggacaaacuuagacugaaaggggucagcuauucauuguguacugccgcuuucacguuuacaaagaucccugccgaaacccuccauggaacugugaccguugaggugcaguacgcaggcacagaugguccaugcaaaguacccgcgcaaauggcugucgacaugcagacccugacuccuguggggagguuaauuacagccaacccaguuauaacggaaaguaccgagaacuccaagaugaugcuggagcuagaucccccguucggcgacagcuacaucgugauuggagucggcgaaaagaagaucacucaccacuggcaucggucugggucaacaauaggaaaggcauuugaggccaccgugcgcggugcuaaaagaauggccguacucggcgacacagcaugggauuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4045 - RNA, 2284 nt, Artificial Sequence
  KX447517.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgccccugcauacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccgcucuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaacacugaucgggacucuccugauguggcuuggacugaacaccaagaauggcagcauuuccuugaugugucucgcucugggugggguuuuaaucuuccugucaacggcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4046 - RNA, 2284 nt, Artificial Sequence
  KU926310.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcgcggacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4047 - RNA, 2284 nt, Artificial Sequence
  KU922923.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcauuagccuacucuauucggugcaucggcgugagcaaucgcgacuuuguagagggcauguccgggggaacuuggguugaugugguccuggaacaugguggcugugugaccgugauggcucaggacaagccuacagucgauauugagcuuguuaccacgacugugucaaacauggccgagguacgaaguuacugcuaugaagcaagcaucucugacauggcuuccgauucaagauguccaacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauacagcccgaaaaccuggaguaccguauuaugcuuagcguucacgggucgcaacacucuggaaugaucgugaaugacacgggucaugaaaccgaugagaaccgcgcaaaggucgagauuacaccuaauuccccaagagcugaagccacucugggcggguucggaucauugggccucgacugugagcccaggaccggucuggauuuuagugacuuauauuaccugacaaugaacaauaaacacuggcucgugcauaaggaaugguuccacgauaucccucuuccauggcacgcuggggccgacacuggcaccccgcauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagauccccgccgagacccugcauggaacugugaccguugaagugcaguacgcaggcacagacgguccuugcaaaguaccagcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4048 - RNA, 2284 nt, Artificial Sequence
  KY075937.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacaugguguccgauucaagaugucccacacaaggggaggcuuaccuugacaagcagagcgacacccaguaugucugcaaaaggacuuugguggaucggggauggggcaaugguugugggcuguucggaaagggcagucuaguuacaugcgccaaauuugcgugcucuaagaaaaugaccggcaaguccauacagccugaaaaccucgaguaccguauuaugcugagcgugcacgggucgcaacacucuggaaugaucgucaaugacacgggucaugaaaccgaugagaaccgcgccaagguggagauuacaccaaauucccccagagcagaagcuacucuuggcggguucggaucacugggcuuggacugugagccuaggaccggucucgauuuuagugaccuguauuacuuaacaaugaacaauaaacacuggcugguacauaaggaaugguuccacgauaucccacucccguggcacgccggggcugacacuggcaccccucauuggaacaauaaagaggcccuuguugaauuuaaggaugcacacgccaaacggcagacaguggucgugcugggaagccaggagggcgcuguccauaccgcguuggcaggggcccuagaggcugaaauggacggagccaagggucgacuguccucuggccaccucaaaugccgccugaagauggauaaacuuagacugaagggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuugaugugucucgcgcuggguggggucuuaauuuuccugucaacggccgugagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4049 - RNA, 2284 nt, Artificial Sequence
  KY003156.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcauuagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaauccugggcuuggacugugagccuaggaccggucucgauuuuucagaccuguauuacuuaacaaugaacaauaaacacuggcugguccauaaggaaugguuccacgauauuccacucccguggcacgcuggggccgacacuggcaccccucauuggaacaauaaagaggcacuuguggaauuuaaggaugcccacgcuaaacggcagacaguaguugugcugggaagucaggagggcgcgguccauaccgcauuggccggggcucuagaggccgaaauggacggagcaaagggucgacugagcuccggccaccucaaaugccgccugaagauggauaaacuuagacugaaaggggugucuuauagcuuguguacugccgcuuucacguuuacaaagauaccugccgagacccuccauggaacugucaccguggaaguucaguacgcaggcacagacgguccaugcaaagugcccgcgcaaauggcuguagacaugcagacccugacuccugucgggagguuaaucacagccaacccagugauuacggagucaaccgaaaacaguaagaugaugcuggagcuagaucccccguucggcgacuccuacaucguuauaggagugggcgagaaaaagauuacucaccacuggcaucggagcgggucuacaaucggaaaggcauuugaagccaccguccgcggugcuaaaagaauggccgugcucggcgauacagcaugggacuucgggucaguaggaggcgcucugaauagucuugguaaggggauccaccagauuuucggcgccgcguuuaagagcuuguucggaggcauguccugguuuucucaaauccugauugggacucuccugauguggcuuggacugaacaccaagaauggcucgaucagcuugaugugucucgcccugggugggguguuaauauuccuguccacggcuguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4050 - RNA, 2284 nt, Artificial Sequence
  KU312313.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuauuaggaaacuccaaacgcggucgcagacuuggcuggagucacgcgaguacaccaagcaccuuaucagaguugaaaauuggauuuuuaggaaccccggguucgcucuggcagccgcugccaucgcgugguugcucggaagcaguacaucccagaaagugauauaucuggucaugauccugcucauugcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauaucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagauuccugccgagacccuccauggaacugugaccguugaagugcaguacgcaggcacagacgguccaugcaaaguacccgcgcaaauggcugucgacaugcagacccugacuccuguggggagguuaauaacagccaacccaguuaucacggagaguaccgaaaacuccaagaugaugcuggagcuagaucccccguucggcgacagcuacauugugaucggagucggcgagaaaaagauaacucaccacuggcaucggucugggucaacaauuggaaaggcauuugaagccaccgugcgcggugcuaaaagaauggccguacucggcgauacagcaugggacuucgggagugugggaggcgcucugaauagccuugguaaggggauccaccagaucuucggcgccgcguuuaaauccuuguucggaggcaugucuugguuuucgcaaauucugaucgggacucuccugauguggcuuggacugaacgccaagaauggcagcauuuccuugaugugucucgcucugggugggguuuuaauauuccugucaaccgcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4051 - RNA, 2284 nt, Artificial Sequence
  KY075935.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacaacgcagccgacgugccgugacacuaccgucccauucuaccagaaaacuccagacgaggucgcagacuuggcuggagucacgggaguacaccaagcaccuuauucgcguugaaaauuggaucuuuagaaaccccggguucgcucuggcagccgcugccauugcgugguugcucggaagcaguacaucccagaaagugaucuaucuggucaugauacugcucaucgcacccgccuacucuauuaggugcaucggcgugagcaaucgggacuuuguagagggcauguccgggggaacuuggguugauguggucuuagaacaugguggcugugugaccgugauggcucaagacaagccaacagucgauauugagcugguuaccacgacugugucaaacauggccgagguacgcaguuacugcuaugaagcaagcaucucugacauggcuuccgauucacgaugucccacacagggggaggccuaccuugacaagcagagcgacacccaguaugugugcaaaagaacuuuggucgauaggggauggggcaaugguugugggcuguucggaaagggcagucuagugacaugcgcgaaauuugccugcucuaagaaaaugaccggcaaguccauacaaccugaaaaccucgaguaccggauuaugcugagcguucacgggucgcagcacucuggaaugaucgugaaugacacgggucaugaaaccgaugagaaccgugcaaaggucgagauuacaccaaauuccccucgcgcugaagccacucuuggcggguucggaucacugggcuuggacugugagccuagaaccggucucgauuuuagugaccuguauuacuuaacaaugaacaauaaacacuggcuggugcauaaggaaugguuccacgauaucccacucccguggcacgcuggggccgacacuggcacaccccauuggaacaauaaagaggcacuuguagaauuuaaggaugcccacgcuaaaaggcagaccguugugguccugggaagccaggagggcgcggugcauaccgcauuggccggggcucuagaggccgaaauggacggagcaaagggucggcuguccucuggccaccucaaaugccgacugaagauggauaaacuucgccugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagauuaauuacagccaacccaguuauaacggagaguaccgaaaacuccaagaugaugcuggagcuagaucccccguucggcgacagcuacaucgugauuggagucggcgagaaaaagaucacucaccacuggcauaggucugggucaacaauaggaaaggcauuugaagccaccgugcggggugcuaaacgcauggccguacucggcgauacagcaugggacuucgggagugugggaggcgcucugaauagccuugguaaggggauucaccaaaucuucggcgccgcguuuaaauccuuguucggaggcaugucuugguuuucgcagauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4052 - RNA, 2284 nt, Artificial Sequence
  KY014320.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaagcucggucgcagacguggcuggagucacgcgaguacacuaagcaccuuauuagaguugaaaauuggaucuuuaggaaccccggguucgcacuggccgcugccgcgauugcaugguugcucggaagcaguaccucccagaaagugaucuaucuggucaugauacugcucaucgccccugcuuacucuauucggugcaucggcgugagcaaucgcgacuuuguagagggcauguccgggggaacauggguugauguggucuuagaacaugguggcugugugacugugauggcccaggacaagccaaccgucgauauugagcugguuacaaccacggugucaaacauggcagagguacgaaguuacugcuaugaagcuagcaucucugacauggccuccgauucaagaugucccacucaaggggaggcguaccuugacaagcagagcgacacacaguaugugugcaaaaggaccuuggucgaucggggauggggcaaugguugugggcuguucggaaagggcagucuagugacuugcgccaaauuugcaugcucuaagaaaaugacaggcaaguccauacagccugaaaaccucgaguaccguauuaugcugagcguucacgggucgcaacacucuggaaugaucgugaaugacaccggucaugaaacggaugagaaccgcgcuaaggucgagauuaccccaaauucccccagagccgaagcuacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4053 - RNA, 2284 nt, Artificial Sequence
  KY328290.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaaaggggucucauauaguuuguguacugccgcuuucacguuuuccaagaucccugccgagacacuccauggaaccgugacugaagagguucaguacgcaggcaccgacgguccaugcaaagugcccgcgcaaauggcuguagacaugcagacacugaccccugucgggagguuaauuacugccaauccagugauaacagaaagcacggagaacucuaagaugaugcuggagcuagaucccccguucggcgacucauacaucguuauuggagugggcgaaaagaagaucacccaccacuggcaucggagugggagcacuauaggaaaggcauuugaggccacaguccgcggugcuaaaagaauggccgugcucggcgauaccgcaugggacuucggguccguaggaggcgcucugaacucucuugguaaggggauucaccagaucuucggcgccgcguuuaaaucguuguucggaggcaugagcugguuuucccaaauccugauugggacacuccugauguggcuuggacugaauacuaagaacggcucaaucaguuugaugugucucgcccugggugggguguuaauuuuccugucuaccgcuguuagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4054 - RNA, 2284 nt, Artificial Sequence
  KU681081.3 prME-short mRNA Design 1 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgccccugcauacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacacuggggcugacaccggcacaccccauuggaauaacaaagaggcccuuguagaauuuaaggaugcacacgccaaacggcagaccguugugguccugggaucccaggagggcgcugugcauacugcguuggcaggggcccuagaggcugaaauggacggagccaagggucgacugucuagcggccaccucaaaugccgccugaagauggauaagcugagacugaaaggggucucauauaguuuguguacggcagccuucacauuuaccaagaucccugcugagacucuccauggaaccgugacaguugaagugcaguacgccggcaccgacgguccaugcaaaguacccgcacaaauggcggucgacaugcagacucugacaccuguggggagguuaauuacggcuaauccaguuauaaccgagggcacugaaaacuccaagaugaugcuggagcuagaucccccguucggagacagcuacaucgugauuggcgucggggagaaaaagaucacacaccacuggcaucggucuggaucaaccauagguaaggccuuugaagcaacagugcgcggcgccaaaagaauggcuguacucggggauacugccugggacuucggaagugugggcgguguucugaacagccuugggaagggcauucaccagaucuucggagcagcuuuuaaauccuuguucggcgggaugucuugguuuucgcaaauccugauuggaacccuccugauguggcuuggccugaauacgaagaacgguagcaucuccuugaugugucucgcccuugggggagucuuaauuuuccugucaaccgcggugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4055 - RNA, 2284 nt, Artificial Sequence
  KX827309.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugaugugucucgcccugggugggguuuuaauuuuccugaguacggcugucucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4056 - RNA, 2284 nt, Artificial Sequence
  KU955593.1 prME-short mRNA Design 1 opt
gggagaaagcuuaccaugaccagcgugggcaucgucgggcugcuccuuacaacugccauggcuguugaggugacgagaaggggaaacgcauacuauauguaccuggaccgguccgaugccggugaagcgauuucuuuccccaccacaaugggcaugaauaagugcuauauacagaucauggacuuggggcacaugugugaugcuacuaugucauacgagugcccuauguuagacgaaggaguagagccagaugacguggauuguuggugcaacaccacaaguaccugggucguguauggcacuugucaucacaaaaagggugaagcccgccgaagccguagagcaguuacacugccgucccauucuaccaggaaacuacaaacgcggucgcagacuuggcucgagucacgcgaguacaccaagcaccugauuagaguggaaaauuggaucuuuaggaaccccggguucgcccuugcugcagccgcuauugccuggcuguugggaagcaguacaucccagaaagucaucuaucucgugaugauacugcugaucgcgccugcauacucuauucggugcaucggcguaagcaaucgcgacuuuguugagggcauguccgggggaacuuggguggaugucgugcucgaacaugguggcugugugaccgucauggcccaggacaagccaacaguugauauugaguuagugaccacgacuguaucaaacauggcugaggugcgaaguuacugcuaugaagccagcaucucugacauggcauccgauucaagaugucccacacaaggggaggcuuaccuggacaagcagagcgacacccaguaugucugcaaaaggacucuuguggaucggggauggggcaaugguuguggguuguucggaaagggcagucugguuacaugcgccaaauuugcgugcucuaagaaaaugaccggcaaguccauacagccugaaaaccuagaguaccguauuaugcucagcgugcacgggucgcaacacucuggaaugaucgucaaugacacgggucaugaaaccgaugagaaccgcgccaagguggagauuacaccaaauucccccagagcagaagcuacucugggcggguucggaucacuuggccuggacugugagccuaggaccgguuuggauuuuagugaccucuauuaccugacaaugaacaauaaacacugguuaguacauaaggaaugguuccacgauaucccacugccguggcacgccggggcugacacuggcacaccccauuggaacaauaaagaggcccucguugaauuuaaggaugcacacgccaaacggcagaccguggucgugcuuggaagccaggagggcgcuguccauaccgcgcuggcaggggccuuggaggcugaaauggacggagccaagggucgacuauccucuggccaccugaaaugccgccucaagauggauaagcugagacuuaaaggggugagcuauucacuguguacugcagccuucacguuuacaaagaucccugcugagaccuugcauggaacuguuaccguggaaguacaguacgccggcacagacgguccaugcaaaguccccgcacaaauggcgguggacaugcagacccucacuccuguugggaggcugauuacagcuaacccagugauaacggagaguaccgaaaacuccaagaugauguuagagcuggaucccccguucggcgacagcuacaucgucauuggagugggcgagaaaaagaucacucaccacuggcaucggucugggucaacaauaggaaaggccuuugaagcaaccguacgcggugccaaaagaauggcugugcuaggcgauacagccugggacuucgggaguguuggaggcgcacucaauagccuggguaaggggauucaccagaucuucggcgcugccuuuaaaucccuuuucggaggcaugucuugguuuucgcaaaucuugauugggacucugcucgucuggcugggacuuaacaccaagaauggcagcaucucccugauguguuuggcgcucgguggggugcugauuuucuuaucaacggccgugagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4057 - RNA, 2284 nt, Artificial Sequence
  KY272987.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugguuugucucgcccuggguggggucuuaauuuuccugaguacggcugugucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4058 - RNA, 2284 nt, Artificial Sequence
  KY007221.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcgugaacaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugguuugucucgcccuggguggggucuuaauuuuccugucaacggcugugagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4059 - RNA, 2284 nt, Artificial Sequence
  EU545988.1 prME-short mRNA Design 1 opt
gggagaaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgcuauugccugguugcucggaaguuccacaucucagaaagucaucuaucuggugaugauacugcucaucgcgccugcauacagcauucggugcaucggcguauccaaccgcgacuuuguugagggcaugucagggggaacuuggguggaugucguguuagaacaugguggcugugugaccgucauggcccaggacaagccagcuguugauauugagcuggugacaaccacgguaaguaauauggccgaggugcgaagcuacugcuaugaagcaucuaucuccgacauggcuucagauagcagaugucccacucaaggggaggccuaccuugacaagcagagugacacacaguaugucugcaaaaggaccuugguggaucggggauggggcaacgguugugggcuguucggaaagggcucucuaguuacuugcgcgaaauuugccugcuccaagaaaaugacaggcaagagcauacagccugaaaaucucgaguaccguauuaugcugucggugcacgggucucaacacuccggaaugaucgucaacgacaccggucaugaaacggaugagaaucgcgcaaagguggagauuaccccaaacucacccagagcugaagccacacuuggcggguucggaagucugggcuuggacugugagccuaggacuggucucgauuuuagcgaccuguauuacuuaaccaugaauaacaaacacuggcugguacauaaggaaugguuccacgauaucccacucccguggcacgcuggggccgacacaggcacuccccauuggaauaacaaagaggcacuuguugaauuuaaggaugcccacgcuaaacggcagaccguggucgugcugggaucccaggagggcgcgguccauacagcauuggccggggcucuagaggccgaaauggacggagcaaagggucgacugucuagcggccaccucaaaugccgccugaagauggauaaacuuagacugaagggggugucauauaguuuguguaccgccgcuuucacuuuuacgaagaucccugccgagacacuccauggaaccguuacuguggaaguacaguacgcaggcaccgacgguccaugcaaaguccccgcgcaaauggcuguggacaugcagacacugaccccuguugggagguuaauuacugccaauccagugauaacagaguccacggaaaacagcaagaugaugcuggagcuagaucccccguucggcgacucuuacaucgucauuggagugggcgagaaaaagaucacccaccacuggcaucggucagggaguacuauaggaaaggcauuugaagccacaguacgcggugcuaaaagaauggccgugcucggcgauaccgcaugggacuucgggagcguuggaggcgcucugaacucccuugguaaggggauucaccagaucuucggcgccgcguuuaaaucuuuguucggaggcaugucgugguuuagccaaauccugauugggacacuccuggucuggcuuggacugaauacuaagaacggcuccaucucauugaccugucucgcccugggugggguguuaauuuuccugaguacggcugugucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4060 - RNA, 2284 nt, Artificial Sequence
  KU681082.3 prME-short mRNA Design 1 opt
gggagaaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgucauugcuugguugcucggaaguuccacaucucagaaagugaucuaucugguaaugauacugcucaucgccccugcguacagcauucggugcaucggcguuuccaaccgcgacuuuguggagggcaugucagggggaacuugggucgaugugguguuagaacaugguggcugugucaccguuauggcacaggacaagccaacaguggauauugagcugguaaccacgacugugaguaauauggccgagguccgaagcuacugcuaugaggcuucuaucuccgacauggccucagauagcagaugucccacacaaggggaagcauaccuugacaagcagagugacacccaguaugugugcaaaaggacuuugguugaucggggauggggcaacgguugugggcuguucggaaagggcucucuagugacaugcgcuaaauuugccugcuccaagaaaaugaccggcaagagcauacagccugaaaaucucgaguaccguauuaugcugucgguccacgggucucaacacuccggaaugaucgugaacgacacgggucaugaaaccgaugagaaucgcgcgaagguagagauuacaccaaacucacccagagccgaagcaacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgcuggggccgacacuggcacaccccauuggaauaacaaagaggcucuuguggaauuuaaggaugcccacgcaaaacggcagaccgucgugguccugggaucccaggagggcgccgugcauaccgcuuuggcgggggcacuagaggccgaaauggacggagcuaagggucgacugucuagcggccaccucaaaugccgccugaagauggauaaacuuagacugaaggggguuucauauaguuuguguacugccgcauucacguuuacaaagaucccugccgagacccuccauggaacugugaccguagaaguccaguacgcuggcacagacgguccaugcaaagugcccgcccaaauggcaguugacaugcagacccugacuccuguggggagguuaauuacagcgaauccagucauaacggaguccaccgaaaacagcaagaugaugcuggagcuagaucccccguucggcgacucuuacaucgugauuggaguaggcgagaaaaagaucacucaccacuggcaucggucagggaguacaauaggaaaggcuuuugaagccaccgugcgcggugcaaaaagaauggccguucucggcgauacagcuugggacuucgggagcgucggaggcgcccugaacucccuugguaaggggauucaccagaucuucggcgcagcuuuuaaaucuuuguucggaggcaugucgugguuuagccaaauccugauugggacucuccugguguggcuuggacugaauaccaagaacggcuccaucucauugacgugucucgcccugggugggguguuaauuuuccugaguaccgcggucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4061 - RNA, 2284 nt, Artificial Sequence
  KX601167.1 prME-short mRNA Design 1 opt
gggagaaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcguaaacaagugcuauauacagaucauggacuuagggcacaugugugaugcuacuaugaguuacgagugcccuaugcuggacgaaggaguggagccagaugacgucgauuguuggugcaauaccacaagcaccugggugguuuauggcacuugucaucacaaaaagggugaagcccgccgaucccguagagcagugacacuaccgucucauucgaccaggaaacuccaaacgcggucacagacuuggcuggagagccgcgaguacaccaagcaccuuauuagagucgaaaacuggaucuuuaggaaucccggguucgcccuggcugcagccgcuauugccugguugcucggaaguuccacaucucagaaagugaucuaucugguaaugauacugcucaucgcgccugcauacagcauucggugcaucggcguuuccaaccgcgacuuuguggagggcaugucagggggaacuugggucgaugugguguuagaacaugguggcugugucaccguuauggcccaggacaagccaacaguggauauugagcugguaaccacgacugugaguaauauggcugagguccgaagcuacugcuaugaagccucuaucuccgacauggcaucagauagcagaugucccacacaaggggaggcuuaccuugacaagcagagugacacccaguaugugugcaaaaggacuuugguugaucggggauggggcaacgguugugggcuguucggaaagggcucucuagugacaugcgccaaauuugcgugcuccaagaaaaugaccggcaagagcauacagccugaaaaucucgaguaccguauuaugcugucgguccacgggucucaacacuccggaaugaucgugaacgacacgggucaugaaaccgaugagaaucgcgccaagguagagauuacaccaaacucacccagagcagaagcuacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgccggggcugacacuggcacaccccauuggaauaacaaagaggcccuuguggaauuuaaggaugcacacgccaaacggcagaccgucgugguccugggaucccaggagggcgcugugcauaccgcguuggcaggggcccuagaggcugaaauggacggagccaagggucgacugucuagcggccaccucaaaugccgccugaagauggauaaacuuagacugaaggggguuucauauaguuuguguacugcagccuucacguuuacaaagaucccugcugagacccuccauggaacugugaccguagaaguccaguacgccggcacagacgguccaugcaaagugcccgcacaaauggcgguugacaugcagacccugacuccuguggggagguuaauuacagcuaauccagucauaacggaguccaccgaaaacagcaagaugaugcuggagcuagaucccccguucggcgacucuuacaucgugauuggaguaggcgauaaaaagaucacucaccacugguaucggucagggaguacaauaggaaaggccuuugaggcaaccgugcgcggugccaaaagaauggcuguucucggcgacacagccugggauuucgggagcgucggaggcgcacugaacucccuugguaaggggauucaucagaucuucggcgcugccuuuaaaucuuuguucggaggcaugucgugguuuagccaaauccugauugggacucuccugguguggcuuggacugaauaccaagaacggcuccaucucauugacgugucucgcgcugggugggguguuaauuuuccugaguaccgccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4062 - RNA, 2284 nt, Artificial Sequence
  KX694533.2 prME-short mRNA Design 1 opt
gggagaaagcuuaccaugaccagcgugggcaucgucgggcugcuccuuacaacugccauggcuguugaggugacgagaaggggauccgcauacuauauguaccuggaccggucugaugccgguaaggcgauuucauuccccaccacauugggcguaaacaaaugcuauauacagaucauggacuuagggcacaugugugaugcuacuaugaguuacgaaugcccuaugcuggacgagggaguggaaccagaugacgucgauuguuggugcaauaccacaagcaccugggugguuuauggcacuugucaucacaagaaaggugaggcccgccgaucccguagagcagugacacuaccgucucauucgaccaggaagcuccaaacgcggucacagacuuggcuggaaagccgcgaguacaccaaacaccuuauuagagucgagaacuggaucuuuaggaaucccggguucgcccuggcugcagccgcuauugccugguugcucggaaguuccacaucucagaaggugaucuaucugguaaugauacugcucaucgcgccugcauacagcauucggugcaucggcguuuccaaccgcgacuuuguggaaggcaugucagggggaacuugggucgaugugguguuagagcaugguggcugugucaccguuauggcccaggacaagccaacaguggauauugaacugguaaccacgacugugaguaauauggcugagguccgaagcuacugcuaugaggccucuaucuccgacauggcaucagauagcagaugucccacacaaggggaggcuuaccuugacaaacagagugacacccaguaugugugcaagaggacuuugguugaucggggauggggcaacgguugugggcuguucggaaaaggcucucuagugacaugcgccaaguuugcgugcuccaaaaagaugaccggcaagagcauacagccugaaaaucucgaauaccguauuaugcugucgguccacgggucucaacacuccggaaugaucgugaacgacauuggucaugagacggaugaaaaucgcgccaaaguagagaucaccccaaacucacccagagcagaggcuacacuuggcggguucggaagucugggcuuggacugugaaccuaggacuggucucgauuuuagcgaccuguauuacuuaaccaugaauaacaagcacuggcugguucauaaagagugguuccacgauaucccacucccguggcacgccggggcugacacaggcacuccccauuggaauaacaaggaagcccuuguggaguuuaaagaugcacacgccaagcggcagaccgucgugguccugggaucccaggaaggcgcugugcauacagcguuggcaggggcccuagaggcugagauggacggagccaaaggucgacugucuagcggccaccucaagugccgccugaagauggauaaacuuagacugaaggggguuucauauaguuuguguaccgcagccuucacuuuuacgaaaauuccugcugaaacacuccauggaaccgugacuguagagguccaguacgccggcaccgacgguccaugcaaggugcccgcacaaauggcgguugacaugcagacacugaccccuguggggagguuaauaacugcuaauccagucaucacagaauccacggagaacagcaaaaugaugcuggaacuagaucccccguucggcgacucuuacauugugaucggaguaggcgauaagaagauaacccaccacuggcaucggucagggaguacuauuggaaaagccuuugaggcaacagugcgcggugccaagagaauggcuguucucggcgacaccgccugggauuucgggagcgucggaggcgcacugaacucccuugguaaagggauccaccagaucuucggcgcugccuuuaagucuuuguucggaggcaugucgugguuuagccaaauucugaucgggacacuccugguguggcuuggacugaauacuaaaaacggcuccauuucauugaccugucucgcgcugggugggguguuaauauuccugaguacggccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4063 - RNA, 2284 nt, Artificial Sequence
  KY288905.1 prME-short mRNA Design 1 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacacaggucacgagacugaugaaaaucgugccaagguagagguuaccccuaacucaccacgcgcggaggccacacuuggcggguucggaagucugggcuuggacugugaacccagaacuggucucgauuuuagcgaccuguacuauuuaaccaugaauaacaaacauuggcuggugcacaaggagugguuccacgauaucccucucccauggcaugcaggggcugacacaggcaccccgcacuggaauaacaaagaagcccuugucgaguuuaaggaugcucaugccaaaaggcagacuguggucgugcugggaucccaggaaggcgcaguucacacggccuuggcuggggcgcuagaggcagagauggacggagccaagggucggcuguucucuggccaucucaagugccgacugaaaauggauaaacuucgccugaagggggugagcuacucauuguguacagcugccuuuaccuucacuaagguacccgcagaaacccuccacggaacagucaccguggagguucaguaugccggcacugacgguccuugcaaagugccagcucaaauggccgucgacaugcagacacugacgcccguggggagauuaaucaccgcaaauccuguaauuacugaaaguacagagaacuccaagaugaugcuggaacuagauccacccuuuggcgacagcuacauagugaucggaguuggcgauaagaaaauuacccaccauuggcacaggucugggucaacaaucggaaaggcguucgaggcuacuguccggggugccaaacgcauggcagugcucggcgacaccgccugggauuucgggagugugggaggcgucuuuaacagccuggguaaggggauacaucagauuuucggcgcugccuuuaaaucccuuuucggaggcaugucuugguuuucgcaaaucuugaucgggacgcugcucguuuggcugggacuuaauaccaagaacggcagcauuucccugacauguuuggcacucgguggggugaugaucuuccugucaacugcugugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4064 - RNA, 2284 nt, Artificial Sequence
  KF268950.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacaucggucacgagacggaugaaaaccgugccaaggucgaggugaccccuaauucaccacgcgcagaggcuacacuuggcggguucggaagucugggcuuggacugugaacccagaacuggucucgauuuuagcgaccuguacuauuuaaccaugaacaauaaacauuggcugguacacaaggagugguuccacgauauuccucucccauggcaugccggggcugacacaggcacuccgcacuggaacaauaaagaagcccuuguugaguuuaaggaugcacaugccaaaaggcagaccguggucgugcugggaucccaggaaggcgcuguccacacagcguuggcaggggcccuagaggcugagauggacggagccaagggucggcuguucucuggccaucucaagugccgacugaaaauggauaaacuucgccugaagggggugagcuacucauuguguaccgcagccuuuacuuucacgaagguucccgcugaaacacuccacggaaccgugacuguagagguccaguaugccggcaccgacgguccuugcaaagugccagcacaaauggcgguugacaugcagacacugacccccguggggagauuaauaacugcuaacccugucaucacagaaaguacggagaacuccaagaugaugcuggaacuagauccacccuuuggcgacagcuacauugugaucggaguaggcgauaagaaaauaacccaccauuggcacaggucugggucaacuauuggaaaggccuucgaggcaacagugcggggugccaaacgcauggcuguucucggcgacaccgccugggauuucgggagugucggaggcguguuuaauagccuggguaagggggugcaucagaucuucggcgcagcuuuuaaaucccuuuucggaggcaugucuugguuuucgcaaaucuugauugggacacugcucgucuggcugggacuuaacacuaagaauggcagcaucucccugaccuguuuggcccucggugggguuaugauuuuccugucaacggcggugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4065 - RNA, 2284 nt, Artificial Sequence
  KF383121.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaucggucacgagaccgaugaaaaucgugcgaagguggagguaacaccuaacucaccacgcgccgaggcaacucuuggcggguucggaagucugggcuuggacugugaacccagaaccggucucgauuuuagcgaccuguacuauuuaacaaugaauaacaaacauuggcugguucacaaggagugguuccacgauauuccucucccauggcaugcuggggccgacacuggcaccccgcacuggaauaacaaagaagcucuuguggaguuuaaggaugcccaugcaaaaaggcagacagucgugguccugggaucccaggaaggcgccgugcacaccgcuuuggcgggggcacuagaggccgagauggacggagcuaagggucggcuguucucuggccaucucaagugccgacugaaaauggauaaacuucgccugaaggggguuagcuacucauuguguacugccgcauuuacguucacaaaggugcccgccgaaacccuccacggaacuguaaccgucgaggugcaguaugcuggcacagacgguccuugcaaaguuccagcccaaauggcaguggacaugcagacccugacucccgucgggagauuaauaacagcgaauccugugaucacggaaaguaccgagaacuccaagaugaugcuggaacuagauccacccuuuggcgacagcuacauuguaaucggagugggcgauaagaaaauaacucaccauuggcacaggucugggucaacaauuggaaaggcuuucgaggccaccguucggggugcaaaacgcauggccguccucggcgacacagcuugggauuucgggagugugggaggcguguuuaacagccuggguaaggggauccaucagaucuucggcgccgcauuuaaaucccuuuucggaggcaugucuugguuuucgcaaauuuugaucgggacucugcucgucuggcugggacuuaauaccaagaacggcagcauuucccugacguguuuggcucucggugggguuaugauauuccugucaaccgccgugagugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4066 - RNA, 2266 nt, Artificial Sequence
  KF268949.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacgagaaccgugccaaggucgaagugacgccuaauucaccacgcgcagaggcuacccuugguggcuucgggagucugggauuggauugugagcccagaacaggccucgacuuuagcgaucuguacuauuuaacuaugaacaauaaacacuggcugguacauaaggaaugguuccacgacaucccucucccauggcacgccggugcugauaccgggacaccgcauuggaacaauaaagaggcccuuguugaauuuaaggacgcacacgccaaaaggcagacuguggucgugcugggcucccaggagggagcuguccauaccgcguuggcaggcgcccuagaagcugagauggauggggccaagggacggcuguucucuggucaccucaagugccgacugaaaauggacaaacuucgccugaagggcgugagcuacucauuguguacagcagccuuuaccuucacuaagguucccgcugagacgcuccaugggacagugaccguagaaguccaguaugccggaacugauggcccuugcaaagugccagcacaaauggcgguugacaugcagacccugacacccguggguagauuaauuaccgcuaacccugucauaacugagaguacagaaaacuccaagaugaugcuggagcuagacccacccuuuggggauagcuacaucgugauuggcguaggagacaagaaaaucacgcaccacuggcauaggucuggcucaaccauagggaaggccuucgaagcaacugugcggggagccaaacgcauggcuguucucggugauacagccugggacuucggcagugucgggggaguguuuaauagccugggcaaggguauucaccagaucuucggggcagcuuuuaaaucccuuuucggcggaaugucuugguuuucgcaaaucuugauuggcacccugcucguguggcuggggcuuaacacaaagaauggaagcaucucccugacuuguuuggcccucggcggugucaugauuuuccugucaaccgcgguuagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4067 - RNA, 2284 nt, Artificial Sequence
  KU955595.1 prME-short mRNA Design 1 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacaccggucacgagacagaugaaaaucgugcgaagguagagguuacuccuaacucaccacgcgccgaggcaacccuuggcggguucggaagucugggcuuggacugugaacccagaacaggucucgauuuuagcgaccuguacuauuuaacuaugaauaacaaacauuggcuggugcacaaggagugguuccacgauaucccucucccauggcaugcuggggccgacaccggcacaccgcacuggaauaacaaagaagcucuugucgaguuuaaggaugcccaugcaaaaaggcagaccguggucgugcugggaucccaggaaggcgccguucacacugcuuuggcgggggcacuagaggccgagauggacggagcuaagggucggcuguucucuggccaucucaagugccgacugaaaauggauaaacuucgccugaagggggugagcuacucauuguguacggccgcauuuacauucaccaagguacccgccgaaacucuccacggaaccgucacaguggagguucaguaugcuggcaccgacgguccuugcaaagugccagcccaaauggcagucgacaugcagacucugacacccguggggagauuaaucacggcgaauccuguaauuaccgaaaguacugagaacuccaagaugaugcuggaacuagauccacccuuuggcgacagcuacauagugaucggaguuggcgauaagaaaauuacacaccauuggcacaggucugggucaaccaucggaaaggcuuucgaggccacaguccggggugcaaaacgcauggccgugcucggcgacacugcuugggauuucgggagugugggaggcgucuuuaacagccuggguaaggggauacaucagauuuucggcgccgcauuuaaaucccuuuucggaggcaugucuugguuuucgcaaaucuugaucgggacccugcucguuuggcugggacuuaauacgaagaacggcagcauuucccugaccuguuuggcucucgguggggugaugaucuuccugucaacagccgugagugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4068 - RNA, 2284 nt, Artificial Sequence
  KF383116.1 prME-short mRNA Design 1 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaacacaagaaaggugaggcccgccgaucccguagagcugugacacuaccaucucauucgaccaggaagcuccagacgcggucacagacuuggcuggaaagccgcgaguauaccaaacaccuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcaugguggcugugucaccguuauggcccaagacaaaccuacaguggauaucgaacugguaaccacgacugugaguaauauggcugagguccgcagcuacugcuacgaggccucuauauccgacauggcaucagauagccgauguccaacacagggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucaacccgaaaaucucgaauaucggaucaugcugucgguccacgggucucagcacuccggaaugauugugaacgacaucggucaugagaccgaugaaaaucgugcgaagguagagguuacaccuaacucaccacgcgccgaggcaacucuuggcggguucggaagucugggcuuggacugugaacccagaaccggucucgauuuuagcgaccuguacuauuuaacaaugaauaacaaacacuggcuggugcauaaggagugguuccacgauaucccucucccauggcacgcuggggccgacacuggcaccccgcauuggaauaacaaagaagcucuugucgaguuuaaggaugcccacgcaaaaaggcagacaguggucgugcugggaucccaggaaggcgccguucauaccgcuuuggcgggggcacuagaggccgagauggacggagcuaagggucggcuguucucuggccaccucaagugccgacugaaaauggauaaacuucgccugaagggggugagcuacucauuguguacugccguaugcacggcagccaagguccccgcugaaacacuccauggaaccgugacuguugaggugcaauaugccggcaccgacgguccuuguaaagucccagcacagauggcgguggacaugcagacacugacccccguagggagauuaauuacugcuaauccugugauaacagaaaguacggagaacuccaagaugaugcuggaacuagauccacccuuuggcgacagcuacaucguuauuggagucggcgauaagaaaaucacccaccacuggcauaggucugggucaacuauaggaaaggccuucgaggcaacagugcggggugccaaacgcauggcugugcucggcgacaccgccugggauuuugggagugucggaggcguuuucaacagccuggguaaggggauucaccaaaucuucggcgcagcuuuuaaaucccuuuucggaggcaugucuugguuuucgcagaucuugauugggacacugcucguguggcugggacuuaauacuaagaacggcagcaucucccugaccugcuuggcccucgguggggugaugauuuuccugucaacggcgguaagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4069 - RNA, 2266 nt, Artificial Sequence
  KX601166.1 prME-short mRNA Design 1 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacgagaaucgugcgaagguagaaguuaccccuaacucaccacgcgccgaggcaacacuugguggcuucgggagucugggauuggauugugagcccagaacuggccucgacuuuagcgaucuguacuauuuaaccaugaauaacaaacacuggcuggugcauaaggaaugguuccacgacaucccucucccauggcacgcuggugccgauacagggacuccgcauuggaauaacaaagaggcucuugucgaauuuaaggacgcccacgcaaaaaggcagaccguggucgugcugggcucccaggagggagccguucauacagcuuuggcgggcgcacuagaagccgagauggauggggcuaagggacggcuguucucuggucaccucaagugccgacugaaaauggacaaacuucgccugaagggcgugagcuacucauuguguaccgccgcauuuacuuucacgaagguacccgccgagacacuccaugggaccgucacuguggaaguucaguaugcuggaaccgauggcccuugcaaagugccagcccaaauggcagucgacaugcagacacugacccccguggguagauuaaucacugcgaauccuguaauuacagagaguacggaaaacuccaagaugaugcuggagcuagacccacccuuuggggauagcuacauagugaucggcguuggagacaagaaaauuacccaccacuggcauaggucuggcucaacuaucgggaaggcuuucgaagccacaguccggggagcaaaacgcauggccgugcucggugauaccgcuugggacuucggcagugucgggggaguguuuaacagccugggcaaggguauacaccagauuuucggggccgcauuuaaaucccuuuucggcggaaugucuugguuuucgcaaaucuugaucggcacacugcucguuuggcuggggcuuaauacuaagaacggaagcauuucccugaccuguuuggcucucggcggugugaugaucuuccugucaacggccgugagugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4070 - RNA, 2284 nt, Artificial Sequence
  KF383118.1 prME-short mRNA Design 1 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugagacacgccgaucccguagaucugucucgcuaagguaucacuacacccggaagcuccaaacgcgcucacagacuuggcuggaaagcagagaguauaaaaagcaucuuauuaugguggagaacuggaucuuuaggaauccaggguucgccauaguuaguguggcuaucaccuggcugaugggauccuugacaucucagaaggucauuuaccucgugaugaucguacugauuguuccggcauacagcaucuccugcauaggcgugucaaaccgggaccuggucgaaggcaugagugggggaacuuggguggaugugguccucgagcacgguggcuguguuaccgaaauggcccaggacaaacccacaguggauauugaguuaguaaccaugacggugagcaauauggcugagguccgcucuuauugcuacgaagccucccugucagacauggcgagcgcaagucgauguccuacucaaggggagccaucucuugauaagcaguccgacacacagagcgugugcaaaagaaccuugggagacaggggcugggguaacggguguggaaucuuuggcaagggcucgcugguuacuugcucuaaauucacaugcuguaagaagaugcccgggaaauccauucagccugaaaaucuagaguaucggaucaugcucccagugcacggaucacaacauagugguaugaucgucaacgauauuggccacgaaaccgacgagaaucgugccaagguggagguaacgcccaacagcccucgcgcugaagccacccugggaggguuuggcucccuuggucuggauugcgagccaagaacaggguuggacuucucugaucucuacuaucugacuaugaauaacaaacauugguuaguucacaaggaaugguuucacgacauaccgcugcccuggcaugcaggcgcugauaccggaacaccucacuggaauaacaaagaggcccucguggaguucaaggacgcgcaugccaaaaggcagacugucgugguccuuggcagccaggaaggggcagugcacaccgcucuggccggagcuuuggaggccgaaauggauggugcaaagggccggcuauuuucagggcaucugaagugucgacucaaaauggacaagcugcgccuuaaaggaguuaguuacucccugugcacagccgcuuucaccuuuacuaaggugccagcggagacguugcacggcacaguaaccgucgaagugcagagcgcagguacugaugggcccuguaaaguuccugcccaaauggcuguggacaugcagacccucacaccagucggcagacugaucaccgccaaucccgugauuacugagucuacagaaaacucaaagaugauguuagagcuggacccgccuuucggagauaguuauaucguaauaggcgugggggacaagaaaauuacgcaccauuggcacaggagcggauccaccaucgguaaggcauuugaggccacuguucggggcgcuaaacgcauggccguccuaggggauacagcaugggacuucggaucugugggcgguguguucaacucgcucgggaagggcauccaucagauuuuuggagcggcuuucaaaagccuguuuggcgggauguccugguucucacaaauccuuauuggaaccuugcuggucuggcucggccugaauacaaagaacgguaguauaucucuuacuugccuggcccucgggggaguuaugaucuuuuugagcaccgcaguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4071 - RNA, 2281 nt, Artificial Sequence
  KX447520.1 prME-short mRNA Design 1 opt
gggagaaagcuuaccaugagcgugggcaucgucgggcugcuccuuaccacagccauggcugcagagguuacuagaaggggauccgccuacuauauguaccuggaccggaacgaugcgggugaagcuauuucuuuccccacgaccuugggcaugaauaagugcuauauacagaucauggacuuagggcacaugugugaugccacaaugucauacgagugcccuaugcuggacgaaggaguggagccagaugacguagauuguuggugcaacacuaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4072 - RNA, 2284 nt, Artificial Sequence
  KU761561.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuagaaggauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4073 - RNA, 2284 nt, Artificial Sequence
  KX806557.2 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauguuuaggaaccccggguucgcucuggcagccgcugccaucgcgugguugcucggaagcaguacaucccagaaagugauuuaucuggucaugauccugcucauagcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauuucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauccagccugaaaaccucgaguaccguauaaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauauuccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaaucacagccaacccaguuauuacggagaguaccgaaaacuccaagaugaugcuggagcuagaucccccguucggcgacagcuacauagugaucggagucggcgagaaaaagauuacucaccacuggcaucggucugggucaacaaucggaaaggcauuugaagccaccgugcgcggugcuaaaagaauggccguacucggcgauacagcaugggacuucgggagugugggaggcgcucugaauagccuugguaaggggauacaccagauuuucggcgccgcguuuaaauccuuguucggaggcaugucuugguuuucgcaaauccugaucgggacucuccugauguggcuuggacugaacaccaagaauggcagcauuuccuugaugugucucgcccugggugggguuuuaaucuuccugucaacggcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4074 - RNA, 2284 nt, Artificial Sequence
  LC191864.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaugaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4075 - RNA, 2284 nt, Artificial Sequence
  KU744693.1 prME-short mRNA Design 1 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgcuauggcccaggacaagccaacaguggauauugagcuggucaccacgacuguuucaaacauggcagaggugcgaaguuacugcuaugaagcuagcaucucugacauggccuccgauucaagaugucccacacaaggggaggcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauacagccugaaaaccucgaguaccguauuaugcugagcgugcacgggucgcaacacucuggaaugcuuguuaaugacacgggucaugaaaccgaugagaaccgcgcuaagguggagaucacaccaaauucccccagagccgaagcuacucugggcggguucggaucauugggccucgacugugagccuaggaccggucuggauuuuagugacuuauauuaccugacaaugaacaauaaacacuggcucgcccauaaggaaugguuccacgauauuccacuuccguggcacgcaggggccgcuacuggcaccccucauuggaacaauaaagaggcgcuggucgaauuuaaggacgcacacgccaaacggcagacagugguaguuuugggaagccaggagggcgcugugcauaccgcccuagcaggggcccuggaggcugaaauggauggagccaagggucgacucuccucuggccaccugaaaugccgccuuaagauggacaagcugagauugaaaggggucagcuauucacucuguacugcagcguucacguuuacaaagaucccugcugagaccguggauggaacugucaccguggaaggccaguacggugggacagacggcccaugcaaaguucccgcccaaauggcaguggacaugcagacccugacuccuguaggaagguuaaucacagccaacccagucauuacggagaguaccgaaaacuccaagaugaugcuggagcuagaucccccguucggcgacagcuacauagugaucgggguuggagagaaaaagauuacucaucacuggcaccggucugguucaacaaucggcaaggcuuuugaagccaccgugcgcggggcaaaaagaauggcuguccucggagauacagccugggacuucggcaguguggguggggcgcugaauagccuuggcaagggaauacaucagauuaucggcgccgcuuucaaauccuuguuugggggaaugucuugguucucgcaaauccugauuggcacucuccugauguggcuuggucugaacaccaagaaugggagcaucuccuugaugugucucgcacugggaggcguauuaauuuuucugucaacggccgugagugguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4076 - RNA, 2275 nt, Artificial Sequence
  KU963574.2 prME-short mRNA Design 1 opt
gggagaaagcuuaccaugggcgccgacgcuagcaucgggauugugucccugcuccuuaccacagucauggcagccgagauaacuagaaggggaucugcguacuauauguaccuggaucggucagacgcugguaaggccaucaguuucguuacgaccuugggcgugaacaaaugccacguacagauuauggauuuagggcauaugugugacgcaacaaugagcuaugaaugccccaugcuggaugagggaguggaaccugacgaugucgacuguuggugcaauacuaccuccacaugggugguuuacggcaccugucaccauaagaaaggugaggcccgccgaucucguagagcugugacucuaccaucgcacucaacaaggaagcuccaaacccggagccagacguggcuggaaagucgcgaguauacuaaacaucuuaucaaggucgagaacuggauuuuuagaaauccgggguucgcacugguggccguagcuaucgccugguugcucggauccucuaccagccagaagguuauauaccuggugaugauccugcucauugcgcccgcauauuccaucaggugcauuggcgucucaaaccgggauuuuguggaaggcaugagugggggaacauggguggacgucguuuuagagcacgguggcugugugacuguaauggcccaggauaaaccuaccguggacaucgaacuggucacaaccacggugagcaauauggcugagguucgcucuuacugcuacgaggccuccauaucagauauggcaagcgacagucgauguccaacucaaggggaggcuuaucuugacaagcagucugauacacaguacgugugcaaaagaaccuuggucgacaggggauggggcaacgguugugggcuguucggaaagggcucccuagugacuugcgccaaauuuacaugcagcaagaagaugaccggcaaaucgauucagcccgaaaaucucgaauaucggaucaugcugucuguacacgggucccaacauucaggaaugauuguuaacgaugagaaucgugcgaagguggaagucacgccuaacaguccacgcgccgaggcaacccuugguggcuucgggagccugggauuggacugugagcccagaacaggccucgauuuuuccgaccuguacuauuuaacuaugaauaacaaacacuggcuggugcauaaggaaugguuccacgauaucccucucccauggcacucuggugcugacaccgagacaccgcauuggaauaacaaagaagcccuugucgaguuuaaggaugcucacgccaaaaggcagacugugguugugcuggggagccaggaaggcgcaguacauaccgccuuggcuggagcgcuagaggcagagauggacggcgccaaggggcggcugucaaguggacaccucaagugccgacugaaaauggauaaacuucgccugaagggugucuccuacagcuuguguacagcugccuucaccuuuacuaaggugcccgcagaaacgcuccauggcacaguuaccguggagguccaguaugccgggagagacggaccuugcaaagugccagcucaaauggccguagacaugcagacucugacccccgugggcagguuaaucacagcaaauccuguuauuaccgaaucuacugagaacucaaagaugaugcuggaacuagauccacccuucggugacaguuacauagucaucggggugggcgauaagaaaauuacacaccacuggcaucggagcggauccaucauaggcaaggcguuugaggcuacggugcgcggggccaaaagaauggcaguccucggagacaccgccugggauuucgguucuguuggcgggguguucaacucgcugggaaagggcauucaccagaucuuuggugcugccuucaaaagccuuuuugggggcauguccugguucucacaaaucuugauuggaacucugcucguguggcugggccuuaauacaaagaacgggaguaucucucugaccuguuuggcacucggaggcguaaugauuuuucugagcacagcugucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4077 - RNA, 2293 nt, Artificial Sequence
  KF383120.1 prME-short mRNA Design 1 opt
gggagaaagcuuaccaugggcgccgacaccagcaucgggauuauaggacugcuccuuacaacugcuauggcagccgagaucacgagaagggguuccgcguacuauauguaccuggaucggucugacgcuggcaaggccauuucauucgcaaccacaaugggggugaacaaaugccacguccagaucauggauuugggacauaugugugacgccacuaugaguuaugaaugccccauguuagaugagggcguugaaccugacgauguggacuguuggugcaauaccacaagcaccuggguaguguacgguacuugucaccauaagaaaggggaggcucgcccaucccgacgugcagucacacugccgucucacucgaccagaaagcuacaaacgaggucacagacuuggcucgaaagccgggaguauaccaaacaucugauuaagguggagaacuggauccuucgcaaucccggauuuacaguugccgcucuggccauggcgugguugcucggcaacaguacuucccagagagugauauaccuggucaugauccugcucauugcacccgccuauucuaucaggugcauuggcgugagcaaucgggauuucguagaagggauguccggagguaccuggguugacguggucuuagagcacggcgggugugugacagugauggcucaggauaagccaaccgucgacaucgaacugguuacgacuacagugucaaacauggccgagguacgcaguuacugcuacgaggcaagcauaucugauauggcuuccgacucacgaugucccacccaaggagaagccuaucuugacaaacagagcgauacucaguacgugugcaagagaacauuggucgacaggggcugggguaauggguguggacuguuuggcaaaggcagucuagugaccugcgcgaaguucacgugcucuaaaaagaugaccgggaaguccauucagccugagaaccucgaauaucggaucaugcugagcguucacggaucgcaacauucugguaugauugugaaugauaucggccacgagacagacgaaaaccgugccaaagucgaggugacuccaaauuccccucgcgcagaggcuacccuugggggauuuggcucacuggguuuggauugugaaccuagaacagggcucgacuucagugaucuguacuauuuaacuaugaacaauaagcauuggcugguacacaaagagugguuucacgacaucccacucccguggcaugccggcgcugauaccggaacaccccacuggaacaauaaggaagcccuuguugaguucaaagacgcacaugccaagaggcagaccguggucgugcugggcagccaggaaggggcuguccacacugcguuggcaggagcccuagaggcugagauggauggugccaaaggccggcuguuuuccgggcaucucaagugccgaauuaagauggacaaacugcgccuuaagggagugucuuacagccuguguacggcagccuucacauuuucaaaaguuccugcugaaaccuugcacggcacugugaccguagagguccaguaugccgguagagacgggccaugcaaggugcccgcacaaauggcgguugauaugcagacacucaccccugugggcaggcugauaacugcuaacccaaucauuacagaaaguacggagaacucccggaugauguuagaacuggaucccccguucggagacagcuacaucgucauaggcgugggggacaaaaagauuacccaccauuggcaccgcucuggaucaacuaucgguaaggccuuugaggcaacaguaagaggcgccaaaaggauggcugugcuaggggauaccgccugggacuucggaaguguuggcggugucuucaauagccucgggaagggcgugcaucagguguuuggagcagcuuucaaaucccuguuuggcgggaugucuugguucucgcaaauccuuauuggaacauugcuggucuggcucggccugaacacuaagaaugguagcaucucccuugccugucuggcguugggaggggccaugauuuuucucucaaccgcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4078 - RNA, 1576 nt, Artificial Sequence; identical to SEQ ID NO: 3853
  KU321639.1 solE mRNA Design 1 opt

SEQ ID NO: 4079 - RNA, 1576 nt, Artificial Sequence; identical to SEQ ID NO: 3854
  KU312312.1 solE mRNA Design 1 opt

SEQ ID NO: 4080 - RNA, 1564 nt, Artificial Sequence; identical to SEQ ID NO: 3855
  AY632535.2 solE mRNA Design 1 opt

SEQ ID NO: 4081 - RNA, 1576 nt, Artificial Sequence; identical to SEQ ID NO: 3854
  KU527068.1 solE mRNA Design 1 opt

SEQ ID NO: 4082 - RNA, 1576 nt, Artificial Sequence
  KX421193.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4083 - RNA, 1576 nt, Artificial Sequence
  LC002520.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaccgugaacgauaucggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4084 - RNA, 1558 nt, Artificial Sequence
  DQ859059.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacgccggggcugacacaggaacuccacacuggaauaacaaagaagcccuuguagaguucaaggacgcgcaugcaaagagacagaccguggucguguugggcucccaggaaggcgccguucacacagcucuggccggggcacuagaggcugaaauggauggagccaaagguaggcucuuuucaggccaucugaagugucggcuuaaaauggacaagcugcgcuugaaaggggugagcuacagucucugcaccgcggccuucacguuuacuaagguccccgcagagacacugcacggaaccgugacuguagagguucaauaugcuggcacagaugguccuuguaaagugccagcccagauggcugucgacaugcagaccuuaacgccgguggggcgacugaucaccgccaaucccgucauuacagaaucuacugagaacuccaagaugaugcucgaacuugauccuccauucggcgacagcuacaucgugauaggaguuggcgauaagaaaauuacccaccauuggcacagaucggggucuacaaucggaaaggcauuugaggccacugugaggggugcuaaacggauggcgguacugggcgacaccgcaugggauuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4085 - RNA, 1564 nt, Artificial Sequence
  KU963573.2 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugagaacagggccaagguggaagucacgcccaauaguccucgggcugaggcaacucugggaggguuuggcagcuugggucucgacugcgagccacgcaccgggcuggauuucucugaccuguacuaccucacaaugaacaauaaacauugguuaguucacaaggaaugguuucaugauauuccccugccuuggcacgccggagcugacacuggcaccccacacuggaacaauaaagaggcccuuguggaguucaaggacgcgcaugcaaagagacagacaguaguggucuugggcucccaggaaggggccgugcacaccgcucuggccggagcacuagaagcugagauggauggugccaaaggcaagcucuuuucagggcaucugaaauguaggcuuaagauggacaaacugcgguugaagggaguuagcuauagucucugcacggcggccuucacuuuuacaaaagugcccgcagagacccugcacggcacugucacaguggaaguacaauacgcugguaccgaugggccuuguaagaucccaguucagauggccguggacaugcagacguuaaccccggucggccgccugauuacagcuaaccccgugaucacugagucuaccgaaaauuccaagaugaugcucgagcuugauccuccauucggagacagcuauauagucauuggcgugggggauaaaaagaucacacaccauuggcaccgaucgggaucuacuauugguaaagccuuugaagcaaccguuagaggcgccaagaggauggcugugcugggggacacagcgugggauuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4086 - RNA, 1576 nt, Artificial Sequence
  KY075939.1 solE mRNA Design 1 opt
gggagaaagcuuaccaugagccagaaggugaucuaccuggucaugauucuccuuauagcccccgcuuauucccugagaugcaucggcguuucuaacagggacuucguggaggggaugucaggagguaccuggguagauguggucuuggaacacggcgggugugugacaguuauggcacaagacaaaccuacuguggauauugaguuagucacgaccacagugaguaauauggccgaaguacggagcuacugcuaugaggcguccaucucugacauggcuucggauucacgcuguccaacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauucaaccggagaaucuugaguacagaaucaugcugagcguccauggaucccagcacucagguaugauagugaacgauacaggccaugaaaccgacgagaauagggcuaaggucgaaaucacgcccaacaguccucgggcagaggccacucuagggggauuuggcagccucggucuggauugcgagccacgcaccgggcuggacuucucugaucucuauuacuuaacaaugaauaacaaacacuggcugguucauaaggaaugguuucacgacauuccccuuccuuggcacgcuggagccgacacuggcaccccacauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauccccgcugagaccuuacacggcacugugacagucgaagugcaauaugccgguaccgacgggccuuguaaaguaccagcucagauggccguugauaugcagacgcugaccccggugggccgacucauuacagcaaaucccgucaucacugaguccaccgaaaacagcaagaugaugcuugagcuggacccuccauuuggagauucguacauagugauuggcgucggggaaaagaaaaucacacaucacuggcauagaucuggauccacuauugguaaggccuucgaggcuaccgugaggggcgcgaaacggauggcaguuuugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4087 - RNA, 1576 nt, Artificial Sequence
  KX447516.1 solE mRNA Design 1 opt
gggagaaagcuuaccaugagcaagaaagugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaggacaagccuacuguggauaucgaguuggucacgaccacagugaguaauauggccgaaguacggagcuacugcuaugaggcguccauuucugacauggcuucggauucacgcuguccaacucaaggagaagccuacuuagacaaacagagcgauacccaguauguuugcaagcgaacacugguggaccguggcugggguaacggguguggacuauuuggcaaaggcagucucgugaccugcgcaaaguucgccuguuccaagaaaaugacugggaagucuauccagccggagaaucuggaguacagaauaaugcuuagcguccauggaucccaacacucagguaugaucgugaacgauacaggccaugaaaccgacgagaauagggcuaaagucgaaauuacgcccaacaguccucgggcagaggccacucugggaggguuuggcagcuugggucucgauugcgagccacgcaccgggcuggacuucucugaucuguauuaccucacaaugaauaacaagcacugguuaguucauaaagaaugguuucacgacaucccccugccuuggcacgcuggagccgacacuggcaccccacauuggaauaacaaggaggcgcuuguggaguucaaggaugcacacgccaaaagacagacaguaguggucuugggcucccaggaaggggcugugcauaccgcccuggcaggagcucuagaagccgagauggacggugcgaagggcaggcucucaagcgggcaccugaaaugucggcuuaagauggauaaacugcgcuugaagggaguuaguuacucucucugcacggccgcauuuacuuucacaaaaauucccgcugagacccugcacggcacugugacagucgaagugcaguaugccgguaccgacgggccuuguaagguaccagcucaaauggccguugauaugcagacguuaaccccggugggccgacugaucacagcaaaucccgucauaacugaguccaccgaaaacagcaagaugaugcucgagcuugacccuccauuuggagauucguacauugugaucggcgucggggagaaaaagauuacacaucacuggcauagaucuggauccacuaucgguaaagccuucgaagcuaccgugaggggcgcgaagcggauggcaguucugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4088 - RNA, 1576 nt, Artificial Sequence
  KX447515.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacugguauagaucuggauccacuaucgguaaggccuucgaggcuaccgugaggggcgcgaaacggauggcaguucugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4089 - RNA, 1576 nt, Artificial Sequence
  KU758874.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaagcucucaagcgggcaccugaaauguaggcuuaagauggauaaacugcgguugaagggaguuaguuacucucucugcacggccgcauuuacuuucacaaaaauucccgcugagacccugcacggcacugugacagucgaagugcaauaugccgguaccgacgggccuuguaagguaccagcucagauggccguugauaugcagacguuaaccccggugggccgccugaucacagcaaaucccgucauaacugaguccaccgaaaacagcaagaugaugcucgagcuugacccuccauuuggagauucguacauugugaucggcgucggggagaaaaagauuacacaucacuggcaucgaucuggauccacuaucgguaaagccuucgaagcuaccgugagaggcgcgaagaggauggcaguucugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4090 - RNA, 1576 nt, Artificial Sequence
  KU729218.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauacgcagaccuuaacaccggugggccgacugaucacugcaaaucccgucauaaccgaguccacagaaaacagcaagaugaugcucgagcuugacccuccauuuggagauucguacauugugaucggcgucggggaaaagaaaauuacucaucacuggcauagaucuggauccaccaucgguaaggccuucgaggcuacagugaggggcgcgaaacggauggcaguucugggggacaccgccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4091 - RNA, 1576 nt, Artificial Sequence
  KU501217.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaauucggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4092 - RNA, 1576 nt, Artificial Sequence
  KU761561.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgcggcguauggcaguucugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4093 - RNA, 1576 nt, Artificial Sequence
  KY075937.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacaugguuucggauucacgcuguccaacucagggagaggcuuacuuagacaagcagagcgauacccaguaugugugcaaacgaacacuggucgaccguggcugggguaacggguguggacuauuuggcaagggcagucucgugaccugcgccaaauucgcauguuccaagaagaugacugggaaaucuauccaaccggaaaaucuggaguacagaauaaugcuuagcgugcauggaucccagcacucagguaugaucgucaacgauacaggccaugaaaccgacgagaauagggccaagguugaaauuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4094 - RNA, 1576 nt, Artificial Sequence
  KY014317.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccauugaaaacagcaagaugaugcucgagcuugacccuccauuuggagauucguacaucgugauuggcgucggggaaaagaaaaucacccaucacuggcauagaucuggauccacaaucgguaaggccuucgaggcuacugugaggggcgcgaaacggauggcaguucugggggacaccgccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4095 - RNA, 1576 nt, Artificial Sequence
  KU870645.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcauuggggaaaagaaaaucacacaucacuggcauagaucuggauccacuaucgguaaggccuucgaggcuaccgucaggggcgcgaaacggauggcagugcugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4096 - RNA, 1576 nt, Artificial Sequence
  KU922923.1 solE mRNA Design 1 opt
gggagaaagcuuaccaugagccagaaggugaucuaccuggucaugauucuccuuauagcccuggcuuauuccaucagaugcauuggcguuucuaacagggacuucguggaggggaugucaggagguaccuggguagauguggucuuggaacacggcgggugugugacaguuauggcacaagacaaacccacuguggauaucgaguuagucacgaccacagugaguaauauggccgaaguacggagcuacugcuaugaggcguccauuucugacauggcuucggauucacgcuguccuacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauccaaccagagaaucuugaguacagaauaaugcugagcguccauggaucccagcacucagguaugaucgugaacgauacaggccaugaaaccgacgagaauagggcuaaggucgaaauuacgccgaacaguccccgggcagaggccacucuagggggauuuggcagccucggucuggauugcgagccucgcaccgggcuggacuucucugaucucuauuacuuaacaaugaauaacaaacacuggcugguucauaaggaaugguuucacgacaucccacuucccuggcacgcuggagccgacacuggcaccccucauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauuccagcugagaccuuacacggcacugugacagucgaagugcaauaugccgguaccgacgggcccuguaaaguaccugcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4097 - RNA, 1576 nt, Artificial Sequence
  KU497555.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcacccaggaaggggcugugcauacggcccuggcaggagcucuagaagccgagauggacggugcgaaaggcaggcucuccucagggcaccugaagugucggcuuaaaauggauaagcugcgcuugaaaggaguuagcuacagucucugcacugccgcauuuacauucaccaagauucccgcugagacucugcacggcacagugaccgucgaagugcaauaugccgguacggacgggccuuguaaaguaccagcucagauggccguugauaugcagaccuuaacaccggugggccgacugaucacugcaaaucccgucauaaccgagucuacagaaaacuccaagaugaugcucgagcuugacccuccauuuggagauagcuacauugugaucggcgucggggaaaagaaaauuacucaucacuggcauagaucgggaucuaccaucgguaaggccuucgaggcuacagugaggggcgcgaaacggauggcaguucugggggacaccgccugggauuuuggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4098 - RNA, 1576 nt, Artificial Sequence
  KU312314.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguauuagcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4099 - RNA, 1576 nt, Artificial Sequence
  KY014314.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaagcacacgccaagagacagacaguaguggucuugggcucccaggaaggggcugugcauaccgcccuggcaggagcucuagaggccgagauggauggugcgaaaggcaggcucucaagcgggcaccugaagugucggcuuaaaauggacaagcugcgcuugaaaggaguuaguuacucucucugcacggccgcauuuacuuucacaaagauucccgcugaaacccugcacggcacugugacagucgaggugcaauaugccgguaccgaugggccuuguaaaguaccagcucagauggccguugacaugcagacguuaaccccggugggccgacugaucacagcaaaucccgucauaacugaauccaccgagaacagcaagaugaugcucgaacuugauccuccauuuggagacucguacauugugaucggcgucggggagaagaaaauuacacaucacuggcauagaucuggauccacuaucgguaaggccuucgaggcuaccgugaggggcgcgaaacggauggcaguucugggggauacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4100 - RNA, 1576 nt, Artificial Sequence
  KX447517.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccgcucugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4101 - RNA, 1576 nt, Artificial Sequence
  KU729217.2 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucaguacgaccgugagcaauauggccgaaguacgguccuacugcuaugaggcgacaauuucugacaucgcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaaggucgaaaucacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacauuccccugccuuggcacgcuggagccgacacuggcaccccacauuggaauaacaaagaggcgcuuguggaguucaaggaugcacacgccaagagacagacagcuguaguguugggcucccaggaaggggccguccauaccgcacuggcuggagcccuagaagcggagauggacggugccaaaggcaggcucucaagcgggcaccugaagugucggcuuaaaauggauaagcugcgcuugaaaggagugaguuacucucucugcacggcagcuuuuacuuucacaaagauccccgccgagacccugcacggcacuguuacaguggaaguccaauaugcugguaccgacgggccuuguaaagugccagcccagauggcaguagauaugcagacguuaaccccgguuggccgacugauaacagccaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggcuuucgaggcgaccgucaggggcgcaaaacggauggccgugcugggggacacagcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4102 - RNA, 1576 nt, Artificial Sequence
  KY328290.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucuccaagauucccgcugagacacugcacggcaccgugacugaagagguccaauaugccgguacagacgggccuuguaaagugccagcucagauggccguagauaugcagaccuuaacgccgguuggccgacugaucaccgcaaaucccgugauaacagaaagcacugagaacucgaagaugaugcucgaacuugacccuccauuuggagauucuuacauugucaucggcgugggggagaagaaaauuacccaucacuggcauagauccggaucaacaaucgguaaggccuucgaggcuacugucaggggcgcgaaacggauggcagugcugggggacaccgccugggauuuuggaaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4103 - RNA, 1576 nt, Artificial Sequence
  KX087101.3 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaauuacaauaugccgguaccgacgggccuuguaaagugccagcucagauggccguagauaugcagacgcugaccccgguuggccgacucaucacagcaaaucccgugauaacugaguccaccgaaaacagcaagaugaugcuugagcuggacccuccauuuggagauucguacauugucaucggcgugggggaaaagaaaauuacacaucacuggcauagaucuggauccacuaucgguaaggccuucgaggcuaccgucaggggcgcgaaacggauggcaguguugggggacacagccugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4104 - RNA, 1576 nt, Artificial Sequence
  KY003156.1 solE mRNA Design 1 opt
gggagaaagcuuaccaugagccagaaggugaucuaccuggucaugauucuccuuauagcccccgcuuauuccaucagaugcauuggcaucucuaacagggacuucguugaggggaugucaggagguaccuggguggauguagugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcauuuugggucucgauugcgagccacgcaccgggcuggacuucagcgaucuguauuaccucacaaugaauaacaaacacugguuaguccauaaggaaugguuucacgacaucccccugccuuggcacgcuggagccgacacuggcaccccacauuggaauaacaaagaggcgcuuguugaguucaaggaugcacacgccaagagacagacagugguaguguugggcucucaggaaggggcuguccauaccgcccuggcaggagcucuagaagccgagauggacggugcgaaaggcaggcucuccucagggcaccugaagugucggcuuaaaauggauaagcugcgcuugaaaggagugagcuacagucucugcacggccgcauuuacuuucacaaagauacccgcugagacccugcacggcacuguuacaguggaaguccaauaugccgguaccgacgggccuuguaaagugccagcucagauggccguagauaugcagacguuaaccccgguuggccgacugauuacagcaaaucccgugaucacugagucuaccgaaaacuccaagaugaugcucgagcuugacccuccauuuggagauagcuacauugucaucggcgugggggaaaagaaaaucacacaucacuggcauagaucgggaucuacuauugguaaggccuucgaggcuaccgucaggggcgcgaaacggauggcagugcugggggacacagccugggauuuuggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4105 - RNA, 1576 nt, Artificial Sequence
  KU758876.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacgguguuaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4106 - RNA, 1576 nt, Artificial Sequence
  KU926310.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccggugcugacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4107 - RNA, 1576 nt, Artificial Sequence
  KU681081.3 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacacuggagcugacaccggcacaccacauuggaauaacaaagaggcccuuguggaguucaaggaugcgcacgcaaagagacagaccguaguggucuugggcucccaggaaggggccgugcauacggcucuggccggagcacuagaagcugagauggacggugccaaaggcaggcucucaagcgggcaccugaagugucggcuuaaaauggauaagcugcgcuugaaaggaguuaguuacucucucugcacugcggccuuuacauucaccaagauucccgcagagacucugcacggcacagugaccgucgaagugcaauaugcugguacggacgggccuuguaaaguaccagcccagauggcuguugauaugcagaccuuaacaccggugggccgacugaucacugccaaucccgucauaaccgagggaacagaaaacuccaagaugaugcucgagcuugacccuccauuuggcgauagcuacauugugaucggggucggagaaaagaaaauuacucaucacuggcauagaucggguucuaccaucggcaaggcauucgaggccacagugaggggagcuaaacggauggcgguucugggggacaccgcaugggauuuuggcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4108 - RNA, 1576 nt, Artificial Sequence
  KU744693.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacagcaauggcccaagacaaaccuacuguugauaucgaguuggugacgaccacagucaguaauauggcggaagugcggagcuacugcuaugaggcuuccauuucugacauggccucggauucacgcuguccaacucagggagaagcauacuuagacaagcagagcgauacccaguauguaugcaaacgaacacugguugaccguggcugggguaacggguguggacuauuuggcaagggcagucucgugaccugcgccaaauucgcuuguuccaagaagaugacugggaaaucuauccaaccggagaaucuggaguacagaauaaugcuuagcguccauggaucccagcacucagguaugcuggugaacgauacaggccaugaaaccgacgagaauagggcaaagguggaaaucacgcccaacaguccucgggccgaggcuacucucgggggauuuggcagcuugggucuggauugcgagccacgcaccgggcuggacuucucugaucucuauuacuuaacaaugaauaacaaacacuggcuggcccauaaggaaugguuucacgacauuccccuuccuuggcacgcgggagcagccacuggcaccccacauuggaauaacaaagaggcuuuggucgaguucaaggacgcccacgcaaagagacagacaguugugguacugggcucccaggaaggggcugugcauaccgcccuagcgggagcccucgaagcagagauggauggugcuaaaggcaggcugucaagcgggcaccuuaagugucggcugaaaauggacaaguugcgccucaaaggagucaguuacucucugugcacggccgcuuuuacuuucacaaagauccccgccgagaccguggauggcacuguuacaguggaaggucaauaugggggcaccgacggaccuuguaaagucccagcacagauggccguggauaugcagacguuaaccccgguaggccgacugauuacagcuaaucccguuaucacugaguccaccgaaaacagcaagaugaugcucgagcuugacccuccauuuggggauucguacauagugauuggagucggugaaaagaaaaucacacaccauuggcacagaucuggcuccacuauugggaaggcguucgaggcaaccgugaggggagccaaacggauggcuguccugggcgacacagccugggauuuugguucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4109 - RNA, 1576 nt, Artificial Sequence
  EU545988.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccugccguggauaucgaguuggucacuacgaccgugaguaauauggcggaaguacggagcuacugcuaugaggcuuccauuucugacauggccucggauucacgcuguccaacacagggagaagcauacuuagacaagcagagcgauacucaguauguuugcaaacgaacccugguggaccguggcugggguaacggguguggacuauuuggcaagggcagucucgucacaugcgccaaauucgcuuguuccaagaagaugaccgggaaaucuauccaaccggagaaucuggaguacagaauaaugcuuagcgugcauggaucccagcacucagguaugaucgugaacgauacuggccaugaaacagacgagaauagggcaaaggucgaaauuacccccaacaguccucgggccgaggcuacgcugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4110 - RNA, 1576 nt, Artificial Sequence
  KY007221.1 solE mRNA Design 1 opt
gggagaaagcuuaccaugagccagaaggugaucuaccuggucaugauucuccuuauagcccccgcuuauuccaucagaugcauuggcguuaacaauagggacuucguggaggggaugucuggagguaccuggguagaugugguccuggaacacggcgggugugugacaguuauggcacaagacaaaccuacuguggauaucgaguuggucacgaccacagugucaaacauggccgaaguacggaguuacugcuaugaggcgagcauuuccgacauggcuucugauucgcgcuguccaacucagggagaagccuacuuagacaagcagucagauacccaguauguuugcaaacgaacacugguggaccguggcugggguaauggguguggacuauuuggcaagggcagccucgugaccugcgcaaaauucgccuguaguaagaagaugacugggaaauccauccaaccggagaaccuggaguacagaauaaugcuuucuguccauggaagccagcacuccgguaugaucgugaaugauacaggccaugaaaccgacgagaacagggcuaaggucgaaauuacgcccaauucaccucgggcagaggccacucugggaggguuuggcaguuugggucucgauugcgagccacgcaccgggcuggacuucagcgaucuguauuaccucacaaugaacaauaaacacugguuaguucauaaggaaugguuucacgacaucccccugccuuggcacgcuggagccgacacuggcaccccacauuggaacaauaaagaggcgcuuguggaguucaaggaugcacacgccaagagacagacaguaguggucuugggcucucaggaaggggcugugcauaccgcccuggcaggagcucuagaagccgagauggacggugcgaaaggcaggcucuccucagggcaccugaagugucggcuuaaaauggauaagcugcgcuugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaccccgucauaacugagucuaccgaaaauuccaagaugaugcucgagcuugacccuccauuuggagauagcuacauugugaucggcgucggggaaaagaaaauuacacaucacuggcauagaucgggaucuacuaucgguaaggccuucgaggcuaccgugaggggcgcgaaacggauggcaguucugggggacacagccugggauuuuggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4111 - RNA, 1576 nt, Artificial Sequence
  KY003152.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcgccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4112 - RNA, 1576 nt, Artificial Sequence
  KX694533.2 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauauuggccaugaaacagacgagaauagggcuaaggucgaaaucacccccaacaguccucgggcagaggccacgcugggaggguuuggcagcuugggucucgauugcgagccacgcacugggcuggacuucucugaucuguauuaccucaccaugaauaacaaacacugguuaguucauaaggaaugguuucacgacauuccccugccuuggcacgcuggagccgacacaggcacuccacauuggaauaacaaagaggcgcuuguggaguucaaggaugcacacgccaagagacagaccguaguggucuugggcucccaggaaggggcugugcauacagcccuggcaggagcucuagaagccgagauggacggugcgaaaggcaggcucucaagcgggcaccugaagugucggcuuaaaauggauaagcugcgcuugaaaggaguuaguuacucucucugcaccgccgcauuuacguucacuaagauccccgcugagacacugcacggcaccgugacugucgaagugcaauaugccgguacagacgggccuuguaaaguaccagcucagauggccguugauaugcagaccuuaacgccggugggccgacugauaaccgcaaaucccgucauuacagaguccacugaaaacagcaagaugaugcucgagcuugacccuccauuuggagauucguacaucgugauuggcgucggggacaagaaaaucacccaucacuggcauagaucuggauccacaaucgguaaggccuucgaagcuacugugaggggcgcgaaacggauggcaguucugggggauaccgccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4113 - RNA, 1576 nt, Artificial Sequence
  KX601167.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggacaagaaaauuacacaucacugguauagaucuggauccacuaucgguaaggccuucgaagcuaccgugaggggcgcgaaacggauggcaguucugggggauacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4114 - RNA, 1576 nt, Artificial Sequence
  KY288905.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggccaugaaacggacgagaauagggccaaggucgaaguuacucccaacaguccucgggcugaggcaacccugggaggguuuggcagcuugggucucgauugcgagccacgcacagggcuggacuucucugaucuguauuaccucacuaugaauaacaaacacugguuagugcauaaggaaugguuucacgacauuccccugccuuggcacgccggagcugacaccggcacaccacauuggaauaacaaagaggcccuuguagaguucaaggaugcgcacgcaaagagacagaccguggucguguugggcucccaggaaggggccguucauacggcucuggccggagcacuagaagcugagauggacggugccaaaggcaggcucuuuucagggcaccugaagugucggcuuaaaauggauaagcugcgcuugaaaggagugagcuacagucucugcacugcggccuucacauuuaccaagguccccgcagagacucugcacggcacagugaccguagaaguucaauaugcugguacggacgggccuuguaaagugccagcccagauggcugucgauaugcagaccuuaacaccggugggccgacugaucacugccaaucccgucauuaccgagucuacagaaaacuccaagaugaugcucgagcuugacccuccauucggagauagcuacaucgugauaggcguuggggacaagaaaauuacucaucacuggcauagaucgggaucuaccaucgguaaggcauuugaagccacagugaggggcgcuaaacggauggcgguacugggggauaccgcaugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4115 - RNA, 1576 nt, Artificial Sequence
  KF268950.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggccuucacuuuuacaaagguccccgcagagacccugcacggcacugugacaguagaaguucaauaugcugguaccgacgggccuuguaaagugccagcccagauggcugucgauaugcagacguuaaccccggugggccgacugauuacagccaaucccgucaucacugagucuaccgaaaacuccaagaugaugcucgagcuugacccuccauucggagauagcuacauagugauuggcguuggggacaagaaaaucacacaucacuggcauagaucgggaucuacuauugguaaggcauuugaagccaccgugaggggcgcuaaacggauggcgguacugggggauacagcaugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4116 - RNA, 1576 nt, Artificial Sequence
  KF383116.1 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggucuguacugccgcaaaggugcccgcugagacacugcacggcaccguaacuguugaagugcaauaugccgguacagacgggccuugcaaagucccagcucagauggccguggauaugcagaccuuaacgccggucggccgacugauuaccgcaaaucccgugaucacagagucuacugaaaacuccaagaugaugcucgagcuugacccuccauucggagauagcuacauaguuauuggcgugggggacaagaaaaucacccaucacuggcauagaucgggaucuacaauugguaaggccuuugaagcuacuguaaggggcgcgaaacggauggcaguccugggggauaccgccugggacuucggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4117 - RNA, 1558 nt, Artificial Sequence
  KU963574.2 solE mRNA Design 1 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacuccggggccgacacagaaacuccacacuggaauaacaaagaggcucuuguagaguucaaggacgcccaugcgaagagacagaccguggucguguugggaucacaggaaggcgcaguucacacagcccuggcuggcgcccuagaagcagagauggauggggcuaaaggaaggcucagcaguggucaucugaagugucggcuuaaaauggacaagcugcgcuugaaaggcgugucuuacucccucugcaccgccgcguuuacguucacuaagguccccgccgagacacugcacgggaccgugacuguagaaguucaauaugcaggacgagauggcccuuguaaagugccagcucagauggccgucgacaugcagacauuaaccccgguggguagacugaucacggcuaaucccgucauuaccgagagcacagaaaacucgaagaugaugcucgagcuugauccuccauuuggggacucuuacaucgugauaggcguuggagauaagaaaauuacucaccauuggcacagguccggcucaaucauugggaaggccuucgaagcaaccgugcggggagccaaacguauggcuguacugggugacacagcgugggauuuuggcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4118 - RNA, 1576 nt, Artificial Sequence
  KF383118.1 solE mRNA Design 1 opt
gggagaaagcuuaccaugagccagaaggugaucuaccuggucaugauuguucucauagugcccgccuauuccaucucuugcauuggcguaucaaacagagaccuuguggaggggaugaguggagguaccugggucgaugugguucuggaacacggcgggugugugacagagauggcucaagacaaaccuacugucgauaucgaauuggugacgaugaccguaagcaauauggcagagguuagguccuacugcuaugaagccucuuuaucggacauggcgucagcuagccgguguccaacacagggagagccgagucuggauaagcaguccgacacucagucugugugcaaacgcacccuaggcgaucgagguugggggaacggauguggcauuuucggcaaggggagccucgucacaugcuccaaauuuaccuguugcaagaagaugcccggaaaaucaauccaaccugagaaucuggaauaccguauaaugcuuccagugcaugguagucagcacagcggcaugaucgugaacgacauugggcaugagacugaugaaaauagagccaaggucgagguuacacccaacucuccuagggcagaggccacccugggaggcuucgguuccuuggggcucgacugugaaccacggacgggacuggauuuuucagaccuguauuaccucacuaugaauaacaaacacugguuagugcauaaggagugguuccacgauaucccccugccuuggcacgcuggcgcagacaccggcacaccacauuggaauaacaaagaagcccuuguagaguuuaaggacgcucacgccaagcgccagacuguggucguguuggggagccaggaaggagcgguucauaccgcacuggccggugcucuagaggccgagauggauggcgcaaaagggagacucuucaguggacaccugaagugcaggcuuaaaauggacaagcugcgguugaaaggcgugucuuauucccucuguacagcugccuuuaccuucacgaaggucccggcggaaacucugcacgguacagugaccguagagguucaaagcgccgggacugauggccccugcaaagugccugcacagauggcugucgacaugcagacauuaaccccagugggacgccugauuacggccaaucccgucaucaccgaaucgacagagaacucuaagaugaugcucgaacuugauccuccauuuggcgacuccuacauagugauugggguuggagauaagaaaaucacucaucacuggcaucgaucagguaguaccauuggcaaggcuuucgaggccacagugagaggggcaaaaaggauggccguacugggagacacugcuugggauuuuggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4119 - RNA, 1576 nt, Artificial Sequence
  KX520666.1 solE mRNA Design 1 opt
gggagaaagcuuaccaugagacagaaggugaucuaccuggucaugauucuccuuauagcccccgcuuauagcaucaggugcauuggcguuuccaaccgggacuucguggaggggaugucuggagguaccuggguagaugugguccuggaacacggcgggugugugacaguuauggcacaagacaaaccuacuguggauaucgaguuggucacgaccacagugucaaauauggccgaaguacgcaguuacugcuaugaggcgagcauuuccgacauggcuucugauucgcgauguccaacucagggagaagccuacuuagacaagcagucagauacccaguauguuugcaaacguacacugguggacagaggcugggguaacggguguggacuauuuggcaagggcagccucgugaccugcgcaaaauucgccuguaguaagaagaugacugggaaauccauccaaccggagaaucuggaguacaggauaaugcuuucuguccauggaagccagcacuccgguaugaucgugaacgauacaggccaugaaaccgacgagaaucgggcuaaggucgaaauuacgcccaacucaccucgcgcagaggccacucugggaggguuuggcaguuugggucucgauugcgagccaagaaccgggcuggacuucagcgaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagaggcagacaguaguggucuugggcucucaggaaggggcugugcauaccgcccuggcaggagcucuagaagccgagauggacggugcgaaaggccggcucuccucagggcaccugaagugucgccuuaaaauggauaagcugcgauugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggcagacugaucacagcaaaucccgucauaacugagucuaccgaaaacuccaagaugaugcucgagcuugacccuccauuuggagauagcuacauugugaucggcgucggggaaaagaaaauuacacaucacuggcauaggucgggaucuacuaucgguaaggccuucgaggcuaccgugcggggcgcgaaacguauggcaguucugggggacacagccugggauuuuggauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4120 - RNA, 1576 nt, Artificial Sequence
  KF383120.1 solE mRNA Design 1 opt
gggagaaagcuuaccaugagccagagagugaucuaccuggucaugauucuccuuauagcccccgcuuauuccaucaggugcauuggcguuucuaaccgggacuucguggaggggaugucaggagguaccuggguagaugugguccuggaacacggcgggugugugacaguuauggcacaagacaagccuacuguggauaucgaguuggucacgaccacagugaguaauauggccgaaguacgcagcuacugcuaugaggcguccauuucugacauggcuucggauucacgauguccaacucagggagaagccuacuuagacaaacagagcgauacccaguauguuugcaagcguacacugguggacagaggcugggguaacggguguggacuauuuggcaaaggcagucucgugaccugcgcaaaguucacuuguuccaaaaagaugacagggaagucuauccaaccggagaaucuggaguacaggauaaugcuuagcguccauggaucccagcacucagguaugaucgugaacgauauuggccaugaaaccgacgagaaucgggccaaagucgaaguuacgcccaacaguccucgcgcugaggcaacucugggaggguuuggcagcuugggucucgauugcgagccaagaaccgggcuggacuucucugaucuguauuaccucacaaugaauaacaagcacugguuagugcauaaagaaugguuucacgacaucccccugccuuggcacgccggagcugacacuggcaccccacauuggaauaacaaggaggcccuuguagaguucaaagaugcgcacgcaaagaggcagacaguggucguguugggcucccaggaaggggccguucauaccgcucuggccggagcacuagaagcugagauggacggugccaagggccggcucuuuucagggcaccugaaaugucgcauuaagauggauaaacuucgacugaagggagugagcuacaguuugugcacggcggccuucacuuuuucuaaaguccccgcagagacacuccacggcaccgugacuguagaaguucaauaugcugguagagacgggccuuguaaggugccagcccagauggcugucgauaugcagacacugaccccggugggcagguuaaucacggccaaucccauaauuaccgaguccacagaaaacagccggaugaugcuggagcucgacccuccauucggagauucguacaucgucauuggcgugggggacaaaaagaucacucaucacuggcaucguucuggauccaccaucgguaaggcauuugaagccacaguucgcggcgcuaaaagaauggcggugcuuggggauacugcaugggacuucggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4121 - RNA, 2359 nt, Artificial Sequence
  ZIKV (strain ZikaSPH2015) Polyprotein(93-804) mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4122 - RNA, 2359 nt, Artificial Sequence
  ZIKV (isolate Z1106033) Polyprotein(93-804) mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4123 - RNA, 2347 nt, Artificial Sequence
  ZIKV (strain MR 766) Polyprotein(93-800) mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4124 - RNA, 2359 nt, Artificial Sequence
  ZIKV (strain NatalRGN) Polyprotein(93-804) mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4125 - RNA, 2284 nt, Artificial Sequence
  ZIKV (strain ZikaSPH2015) Polyprotein(108-794) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4126 - RNA, 2284 nt, Artificial Sequence
  ZIKV (isolate Z1106033) Polyprotein(108-794) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4127 - RNA, 2272 nt, Artificial Sequence
  ZIKV (strain MR 766) Polyprotein(108-790) mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4128 - RNA, 2284 nt, Artificial Sequence
  ZIKV (strain NatalRGN) Polyprotein(108-794) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4129 - RNA, 1576 nt, Artificial Sequence
  ZIKV (strain ZikaSPH2015) Polyprotein(273-723) mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4130 - RNA, 1576 nt, Artificial Sequence
  ZIKV (isolate Z1106033) Polyprotein(273-723) mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4131 - RNA, 1564 nt, Artificial Sequence
  ZIKV (strain MR 766) Polyprotein(273-719) mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4132 - RNA, 1576 nt, Artificial Sequence; identical to SEQ ID NO: 4130
  ZIKV (strain NatalRGN) Polyprotein(273-723) mRNA Design 1 opt

SEQ ID NO: 4133 - RNA, 2284 nt, Artificial Sequence
  ZIKV (strain ZikaSPH2015) Polyprotein(108-794)(F398S) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4134 - RNA, 2284 nt, Artificial Sequence
  ZIKV (isolate Z1106033) Polyprotein(108-794)(F398S) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4135 - RNA, 2272 nt, Artificial Sequence
  ZIKV (strain MR 766) Polyprotein(108-790)(F398S) mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4136 - RNA, 2284 nt, Artificial Sequence
  ZIKV (strain NatalRGN) Polyprotein(108-794)(F398S) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4137 - RNA, 2284 nt, Artificial Sequence
  ZIKV (strain ZikaSPH2015) Polyprotein(108-794)(N444Q) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4138 - RNA, 2284 nt, Artificial Sequence
  ZIKV (isolate Z1106033) Polyprotein(108-794)(N444Q) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4139 - RNA, 2284 nt, Artificial Sequence
  ZIKV (strain NatalRGN) Polyprotein(108-794)(N444Q) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4140 - RNA, 2284 nt, Artificial Sequence
  ZIKV (strain ZikaSPH2015) Polyprotein(108-694)-Cterm-JAEV1-E(400-500) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4141 - RNA, 2284 nt, Artificial Sequence
  ZIKV (isolate Z1106033) Polyprotein(108-694)-Cterm-JAEV1-E(400-500) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4142 - RNA, 2272 nt, Artificial Sequence
  ZIKV (strain MR 766) Polyprotein(108-690)-Cterm-JAEV1-E(400-500) mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4143 - RNA, 2284 nt, Artificial Sequence
  ZIKV (strain NatalRGN) Polyprotein(108-694)-Cterm-JAEV1-E(400-500) mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4144 - RNA, 2359 nt, Artificial Sequence; identical to SEQ ID NO: 4121
  ZIKV (strain ZikaSPH2015) Polyprotein(93-804) mRNA Design 1 opt

SEQ ID NO: 4145 - RNA, 2356 nt, Artificial Sequence
  ZIKV prME variant mRNA Design 1 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4146 - RNA, 2353 nt, Artificial Sequence
  ZIKV prME variant mRNA Design 1 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4147 - RNA, 2350 nt, Artificial Sequence
  ZIKV prME variant mRNA Design 1 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4148 - RNA, 2347 nt, Artificial Sequence
  ZIKV prME variant mRNA Design 1 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4149 - RNA, 2344 nt, Artificial Sequence
  ZIKV prME variant mRNA Design 1 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4150 - RNA, 2341 nt, Artificial Sequence
  ZIKV prME variant mRNA Design 1 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4151 - RNA, 2338 nt, Artificial Sequence
  ZIKV prME variant mRNA Design 1 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4152 - RNA, 2335 nt, Artificial Sequence
  ZIKV prME variant mRNA Design 1 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4153 - RNA, 2332 nt, Artificial Sequence
  ZIKV prME variant mRNA Design 1 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4154 - RNA, 2329 nt, Artificial Sequence
  ZIKV prME variant mRNA Design 1 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4155 - RNA, 2326 nt, Artificial Sequence
  ZIKV prME variant mRNA Design 1 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4156 - RNA, 2323 nt, Artificial Sequence
  ZIKV prME variant mRNA Design 1 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4157 - RNA, 2320 nt, Artificial Sequence
  ZIKV prME variant mRNA Design 1 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4158 - RNA, 2317 nt, Artificial Sequence
  ZIKV prME variant mRNA Design 1 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4159 - RNA, 2314 nt, Artificial Sequence
  ZIKV prME variant mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4160 - RNA, 2314 nt, Artificial Sequence
  ZIKV prME variant mRNA Design 1 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4161 - RNA, 2326 nt, Artificial Sequence
  ZIKV prME variant mRNA Design 1 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4162 - RNA, 2350 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4163 - RNA, 2350 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4164 - RNA, 2341 nt, Artificial Sequence
  ZIKV prME variant mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4165 - RNA, 2338 nt, Artificial Sequence
  ZIKV prME variant mRNA Design 1 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4166 - RNA, 2335 nt, Artificial Sequence
  ZIKV prME variant mRNA Design 1 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4167 - RNA, 2332 nt, Artificial Sequence
  ZIKV prME variant mRNA Design 1 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4168 - RNA, 2329 nt, Artificial Sequence
  ZIKV prME variant mRNA Design 1 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4169 - RNA, 2326 nt, Artificial Sequence
  ZIKV prME variant mRNA Design 1 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4170 - RNA, 2323 nt, Artificial Sequence
  ZIKV prME variant mRNA Design 1 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4171 - RNA, 2320 nt, Artificial Sequence
  ZIKV prME variant mRNA Design 1 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4172 - RNA, 2317 nt, Artificial Sequence
  ZIKV prME variant mRNA Design 1 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4173 - RNA, 2314 nt, Artificial Sequence
  ZIKV prME variant mRNA Design 1 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4174 - RNA, 2311 nt, Artificial Sequence
  ZIKV prME variant mRNA Design 1 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4175 - RNA, 2308 nt, Artificial Sequence
  ZIKV prME variant mRNA Design 1 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4176 - RNA, 2305 nt, Artificial Sequence
  ZIKV prME variant mRNA Design 1 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4177 - RNA, 2302 nt, Artificial Sequence
  ZIKV prME variant mRNA Design 1 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4178 - RNA, 2299 nt, Artificial Sequence
  ZIKV prME variant mRNA Design 1 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4179 - RNA, 2296 nt, Artificial Sequence
  ZIKV prME variant mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4180 - RNA, 2296 nt, Artificial Sequence
  ZIKV prME variant mRNA Design 1 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4181 - RNA, 2308 nt, Artificial Sequence
  ZIKV prME variant mRNA Design 1 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4182 - RNA, 2332 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4183 - RNA, 2332 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4184 - RNA, 2332 nt, Artificial Sequence
  ZIKV prME variant mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4185 - RNA, 2329 nt, Artificial Sequence
  ZIKV prME variant mRNA Design 1 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4186 - RNA, 2326 nt, Artificial Sequence
  ZIKV prME variant mRNA Design 1 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4187 - RNA, 2323 nt, Artificial Sequence
  ZIKV prME variant mRNA Design 1 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4188 - RNA, 2320 nt, Artificial Sequence
  ZIKV prME variant mRNA Design 1 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4189 - RNA, 2317 nt, Artificial Sequence
  ZIKV prME variant mRNA Design 1 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4190 - RNA, 2314 nt, Artificial Sequence
  ZIKV prME variant mRNA Design 1 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4191 - RNA, 2311 nt, Artificial Sequence
  ZIKV prME variant mRNA Design 1 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4192 - RNA, 2308 nt, Artificial Sequence
  ZIKV prME variant mRNA Design 1 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4193 - RNA, 2305 nt, Artificial Sequence
  ZIKV prME variant mRNA Design 1 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4194 - RNA, 2302 nt, Artificial Sequence
  ZIKV prME variant mRNA Design 1 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4195 - RNA, 2299 nt, Artificial Sequence
  ZIKV prME variant mRNA Design 1 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4196 - RNA, 2296 nt, Artificial Sequence
  ZIKV prME variant mRNA Design 1 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4197 - RNA, 2293 nt, Artificial Sequence
  ZIKV prME variant mRNA Design 1 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4198 - RNA, 2290 nt, Artificial Sequence
  ZIKV prME variant mRNA Design 1 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4199 - RNA, 2287 nt, Artificial Sequence
  ZIKV prME variant mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4200 - RNA, 2287 nt, Artificial Sequence
  ZIKV prME variant mRNA Design 1 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4201 - RNA, 2299 nt, Artificial Sequence
  ZIKV prME variant mRNA Design 1 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4202 - RNA, 2323 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4203 - RNA, 2323 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4204 - RNA, 2329 nt, Artificial Sequence
  ZIKV prME variant mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4205 - RNA, 2323 nt, Artificial Sequence
  ZIKV prME variant mRNA Design 1 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4206 - RNA, 2326 nt, Artificial Sequence
  ZIKV prME variant mRNA Design 1 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4207 - RNA, 2320 nt, Artificial Sequence
  ZIKV prME variant mRNA Design 1 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4208 - RNA, 2317 nt, Artificial Sequence
  ZIKV prME variant mRNA Design 1 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4209 - RNA, 2314 nt, Artificial Sequence
  ZIKV prME variant mRNA Design 1 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4210 - RNA, 2311 nt, Artificial Sequence
  ZIKV prME variant mRNA Design 1 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4211 - RNA, 2308 nt, Artificial Sequence
  ZIKV prME variant mRNA Design 1 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4212 - RNA, 2305 nt, Artificial Sequence
  ZIKV prME variant mRNA Design 1 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4213 - RNA, 2302 nt, Artificial Sequence
  ZIKV prME variant mRNA Design 1 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4214 - RNA, 2299 nt, Artificial Sequence
  ZIKV prME variant mRNA Design 1 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4215 - RNA, 2296 nt, Artificial Sequence
  ZIKV prME variant mRNA Design 1 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4216 - RNA, 2293 nt, Artificial Sequence
  ZIKV prME variant mRNA Design 1 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4217 - RNA, 2290 nt, Artificial Sequence
  ZIKV prME variant mRNA Design 1 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4218 - RNA, 2287 nt, Artificial Sequence
  ZIKV prME variant mRNA Design 1 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4219 - RNA, 2284 nt, Artificial Sequence; identical to SEQ ID NO: 4125
  ZIKV (strain ZikaSPH2015) Polyprotein(108-794) mRNA Design 1 opt

SEQ ID NO: 4220 - RNA, 2284 nt, Artificial Sequence
  ZIKV prME variant mRNA Design 1 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4221 - RNA, 2296 nt, Artificial Sequence
  ZIKV prME variant mRNA Design 1 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4222 - RNA, 2320 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4223 - RNA, 2320 nt, Artificial Sequence
  ZIKV prME variant mRNA Design 1 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4224 - RNA, 2359 nt, Artificial Sequence; identical to SEQ ID NO: 4121
  KU321639.1 prME-long mRNA Design 1 opt

SEQ ID NO: 4225 - RNA, 2359 nt, Artificial Sequence; identical to SEQ ID NO: 4122
  KU312312.1 prME-long mRNA Design 1 opt

SEQ ID NO: 4226 - RNA, 2347 nt, Artificial Sequence; identical to SEQ ID NO: 4123
  AY632535.2 prME-long mRNA Design 1 opt

SEQ ID NO: 4227 - RNA, 2359 nt, Artificial Sequence; identical to SEQ ID NO: 4124
  KU527068.1 prME-long mRNA Design 1 opt

SEQ ID NO: 4228 - RNA, 2359 nt, Artificial Sequence
  KU720415.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4229 - RNA, 2341 nt, Artificial Sequence
  DQ859059.1 prME-long mRNA Design 1 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4230 - RNA, 2359 nt, Artificial Sequence
  KX377335.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4231 - RNA, 2359 nt, Artificial Sequence
  LC002520.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4232 - RNA, 2347 nt, Artificial Sequence
  KU963573.2 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4233 - RNA, 2359 nt, Artificial Sequence
  KX694534.2 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4234 - RNA, 2359 nt, Artificial Sequence
  KX447520.1 prME-long mRNA Design 1 opt
gggagaaagcuuaccaugagaaucaucaacgccagaaaggagaagaagagaagaggcgccgacgccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4235 - RNA, 2359 nt, Artificial Sequence
  KX369547.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4236 - RNA, 2359 nt, Artificial Sequence
  KX447515.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4237 - RNA, 2359 nt, Artificial Sequence
  KU501217.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4238 - RNA, 2359 nt, Artificial Sequence
  KU312314.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4239 - RNA, 2359 nt, Artificial Sequence
  KX446950.2 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4240 - RNA, 2359 nt, Artificial Sequence
  KY003157.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4241 - RNA, 2359 nt, Artificial Sequence
  KX811222.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4242 - RNA, 2359 nt, Artificial Sequence
  KX447516.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4243 - RNA, 2359 nt, Artificial Sequence
  KX520666.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4244 - RNA, 2359 nt, Artificial Sequence
  KU729218.1 prME-long mRNA Design 1 opt
gggagaaagcuuaccaugagaaucaucaacgccagaaaggagaagaagagaagaagcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4245 - RNA, 2359 nt, Artificial Sequence
  KU761561.1 prME-long mRNA Design 1 opt
gggagaaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4246 - RNA, 2359 nt, Artificial Sequence
  KY317938.1 prME-long mRNA Design 1 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4247 - RNA, 2359 nt, Artificial Sequence
  KY075939.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4248 - RNA, 2359 nt, Artificial Sequence
  KX806557.2 prME-long mRNA Design 1 opt
gggagaaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4249 - RNA, 2359 nt, Artificial Sequence
  KU870645.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4250 - RNA, 2359 nt, Artificial Sequence
  KU729217.2 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4251 - RNA, 2359 nt, Artificial Sequence
  KU497555.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4252 - RNA, 2359 nt, Artificial Sequence
  KX087101.3 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4253 - RNA, 2359 nt, Artificial Sequence
  KY075932.1 prME-long mRNA Design 1 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4254 - RNA, 2359 nt, Artificial Sequence
  KY014317.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4255 - RNA, 2359 nt, Artificial Sequence
  KU758876.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4256 - RNA, 2359 nt, Artificial Sequence
  KU758874.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4257 - RNA, 2359 nt, Artificial Sequence
  KY014314.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4258 - RNA, 2359 nt, Artificial Sequence
  KU926310.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4259 - RNA, 2359 nt, Artificial Sequence
  KU761560.1 prME-long mRNA Design 1 opt
gggagaaagcuuaccaugagaaucaucaacgccggcaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4260 - RNA, 2359 nt, Artificial Sequence
  KY317939.1 prME-long mRNA Design 1 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4261 - RNA, 2359 nt, Artificial Sequence
  KY075937.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4262 - RNA, 2359 nt, Artificial Sequence
  LC191864.1 prME-long mRNA Design 1 opt
gggagaaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4263 - RNA, 2359 nt, Artificial Sequence
  KX447517.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4264 - RNA, 2359 nt, Artificial Sequence
  KU922923.1 prME-long mRNA Design 1 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4265 - RNA, 2359 nt, Artificial Sequence
  KY003156.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4266 - RNA, 2359 nt, Artificial Sequence
  KU312313.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4267 - RNA, 2359 nt, Artificial Sequence
  KY075935.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4268 - RNA, 2359 nt, Artificial Sequence
  KY014320.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4269 - RNA, 2359 nt, Artificial Sequence
  KX827309.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4270 - RNA, 2359 nt, Artificial Sequence
  KU681081.3 prME-long mRNA Design 1 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4271 - RNA, 2359 nt, Artificial Sequence
  KU744693.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcggcgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4272 - RNA, 2359 nt, Artificial Sequence
  KY328290.1 prME-long mRNA Design 1 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4273 - RNA, 2359 nt, Artificial Sequence
  KX694532.2 prME-long mRNA Design 1 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4274 - RNA, 2359 nt, Artificial Sequence
  KU955593.1 prME-long mRNA Design 1 opt
gggagaaagcuuaccaugagaaucaucaacgccagaaaggagaagaagagaagaggcaccgacaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4275 - RNA, 2359 nt, Artificial Sequence
  KY272987.1 prME-long mRNA Design 1 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4276 - RNA, 2359 nt, Artificial Sequence
  EU545988.1 prME-long mRNA Design 1 opt
gggagaaagcuuaccaugagaaucaucaacgccagaaaggagaagaagagaagaggcaccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4277 - RNA, 2359 nt, Artificial Sequence
  KU681082.3 prME-long mRNA Design 1 opt
gggagaaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4278 - RNA, 2359 nt, Artificial Sequence
  KX601167.1 prME-long mRNA Design 1 opt
gggagaaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4279 - RNA, 2359 nt, Artificial Sequence
  KX694533.2 prME-long mRNA Design 1 opt
gggagaaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4280 - RNA, 2359 nt, Artificial Sequence
  KY288905.1 prME-long mRNA Design 1 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4281 - RNA, 2359 nt, Artificial Sequence
  KF268950.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4282 - RNA, 2359 nt, Artificial Sequence
  KF383121.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4283 - RNA, 2341 nt, Artificial Sequence
  KF268949.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4284 - RNA, 2359 nt, Artificial Sequence
  KU955595.1 prME-long mRNA Design 1 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4285 - RNA, 2359 nt, Artificial Sequence
  KF383116.1 prME-long mRNA Design 1 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4286 - RNA, 2341 nt, Artificial Sequence
  KU963574.2 prME-long mRNA Design 1 opt
gggagaaagcuuaccaugagaaucaucaacgccagaaaggagagaaagagaagaggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4287 - RNA, 2341 nt, Artificial Sequence
  KX601166.1 prME-long mRNA Design 1 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4288 - RNA, 2359 nt, Artificial Sequence
  KF383118.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4289 - RNA, 2353 nt, Artificial Sequence
  KF383120.1 prME-long mRNA Design 1 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccgacgugggcugcagcguggacuucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4290 - RNA, 2284 nt, Artificial Sequence; identical to SEQ ID NO: 4125
  KU321639.1 prME-short mRNA Design 1 opt

SEQ ID NO: 4291 - RNA, 2284 nt, Artificial Sequence; identical to SEQ ID NO: 4126
  KU312312.1 prME-short mRNA Design 1 opt

SEQ ID NO: 4292 - RNA, 2272 nt, Artificial Sequence; identical to SEQ ID NO: 4127
  AY632535.2 prME-short mRNA Design 1 opt

SEQ ID NO: 4293 - RNA, 2284 nt, Artificial Sequence; identical to SEQ ID NO: 4128
  KU527068.1 prME-short mRNA Design 1 opt

SEQ ID NO: 4294 - RNA, 2284 nt, Artificial Sequence
  KX421193.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4295 - RNA, 2284 nt, Artificial Sequence
  KX377335.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4296 - RNA, 2284 nt, Artificial Sequence
  LC002520.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4297 - RNA, 2266 nt, Artificial Sequence
  DQ859059.1 prME-short mRNA Design 1 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4298 - RNA, 2272 nt, Artificial Sequence
  KU963573.2 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4299 - RNA, 2284 nt, Artificial Sequence
  KX694534.2 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4300 - RNA, 2284 nt, Artificial Sequence
  KX369547.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4301 - RNA, 2284 nt, Artificial Sequence
  KX447515.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4302 - RNA, 2284 nt, Artificial Sequence
  KU729218.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4303 - RNA, 2284 nt, Artificial Sequence
  KU501217.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4304 - RNA, 2284 nt, Artificial Sequence
  KU312314.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4305 - RNA, 2284 nt, Artificial Sequence
  KX446950.2 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4306 - RNA, 2284 nt, Artificial Sequence
  KY003157.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4307 - RNA, 2284 nt, Artificial Sequence
  KX811222.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4308 - RNA, 2284 nt, Artificial Sequence
  KX447516.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4309 - RNA, 2284 nt, Artificial Sequence
  KX520666.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4310 - RNA, 2284 nt, Artificial Sequence
  KU497555.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4311 - RNA, 2284 nt, Artificial Sequence
  KY075939.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4312 - RNA, 2284 nt, Artificial Sequence
  KY075932.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4313 - RNA, 2284 nt, Artificial Sequence
  KU870645.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4314 - RNA, 2284 nt, Artificial Sequence
  KU729217.2 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4315 - RNA, 2284 nt, Artificial Sequence
  KX087101.3 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4316 - RNA, 2284 nt, Artificial Sequence
  KY014317.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4317 - RNA, 2284 nt, Artificial Sequence
  KU758876.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4318 - RNA, 2284 nt, Artificial Sequence
  KU758874.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4319 - RNA, 2284 nt, Artificial Sequence
  KY317939.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4320 - RNA, 2284 nt, Artificial Sequence
  KY014314.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4321 - RNA, 2284 nt, Artificial Sequence
  KX447517.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4322 - RNA, 2284 nt, Artificial Sequence
  KU926310.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4323 - RNA, 2284 nt, Artificial Sequence
  KU922923.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4324 - RNA, 2284 nt, Artificial Sequence
  KY075937.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4325 - RNA, 2284 nt, Artificial Sequence
  KY003156.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4326 - RNA, 2284 nt, Artificial Sequence
  KU312313.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4327 - RNA, 2284 nt, Artificial Sequence
  KY075935.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4328 - RNA, 2284 nt, Artificial Sequence
  KY014320.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4329 - RNA, 2284 nt, Artificial Sequence
  KY328290.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4330 - RNA, 2284 nt, Artificial Sequence
  KU681081.3 prME-short mRNA Design 1 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4331 - RNA, 2284 nt, Artificial Sequence
  KX827309.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4332 - RNA, 2284 nt, Artificial Sequence
  KU955593.1 prME-short mRNA Design 1 opt
gggagaaagcuuaccaugaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4333 - RNA, 2284 nt, Artificial Sequence
  KY272987.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4334 - RNA, 2284 nt, Artificial Sequence
  KY007221.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4335 - RNA, 2284 nt, Artificial Sequence
  EU545988.1 prME-short mRNA Design 1 opt
gggagaaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4336 - RNA, 2284 nt, Artificial Sequence
  KU681082.3 prME-short mRNA Design 1 opt
gggagaaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4337 - RNA, 2284 nt, Artificial Sequence
  KX601167.1 prME-short mRNA Design 1 opt
gggagaaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4338 - RNA, 2284 nt, Artificial Sequence
  KX694533.2 prME-short mRNA Design 1 opt
gggagaaagcuuaccaugaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4339 - RNA, 2284 nt, Artificial Sequence
  KY288905.1 prME-short mRNA Design 1 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4340 - RNA, 2284 nt, Artificial Sequence
  KF268950.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4341 - RNA, 2284 nt, Artificial Sequence
  KF383121.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4342 - RNA, 2266 nt, Artificial Sequence
  KF268949.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4343 - RNA, 2284 nt, Artificial Sequence
  KU955595.1 prME-short mRNA Design 1 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4344 - RNA, 2284 nt, Artificial Sequence
  KF383116.1 prME-short mRNA Design 1 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4345 - RNA, 2266 nt, Artificial Sequence
  KX601166.1 prME-short mRNA Design 1 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4346 - RNA, 2284 nt, Artificial Sequence
  KF383118.1 prME-short mRNA Design 1 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4347 - RNA, 2281 nt, Artificial Sequence
  KX447520.1 prME-short mRNA Design 1 opt
gggagaaagcuuaccaugagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4348 - RNA, 2284 nt, Artificial Sequence
  KU761561.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4349 - RNA, 2284 nt, Artificial Sequence
  KX806557.2 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4350 - RNA, 2284 nt, Artificial Sequence
  LC191864.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4351 - RNA, 2284 nt, Artificial Sequence
  KU744693.1 prME-short mRNA Design 1 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4352 - RNA, 2275 nt, Artificial Sequence
  KU963574.2 prME-short mRNA Design 1 opt
gggagaaagcuuaccaugggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4353 - RNA, 2293 nt, Artificial Sequence
  KF383120.1 prME-short mRNA Design 1 opt
gggagaaagcuuaccaugggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4354 - RNA, 1576 nt, Artificial Sequence; identical to SEQ ID NO: 4129
  KU321639.1 solE mRNA Design 1 opt

SEQ ID NO: 4355 - RNA, 1576 nt, Artificial Sequence; identical to SEQ ID NO: 4130
  KU312312.1 solE mRNA Design 1 opt

SEQ ID NO: 4356 - RNA, 1564 nt, Artificial Sequence; identical to SEQ ID NO: 4131
  AY632535.2 solE mRNA Design 1 opt

SEQ ID NO: 4357 - RNA, 1576 nt, Artificial Sequence; identical to SEQ ID NO: 4130
  KU527068.1 solE mRNA Design 1 opt

SEQ ID NO: 4358 - RNA, 1576 nt, Artificial Sequence
  KX421193.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4359 - RNA, 1576 nt, Artificial Sequence
  LC002520.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4360 - RNA, 1558 nt, Artificial Sequence
  DQ859059.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4361 - RNA, 1564 nt, Artificial Sequence
  KU963573.2 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4362 - RNA, 1576 nt, Artificial Sequence
  KY075939.1 solE mRNA Design 1 opt
gggagaaagcuuaccaugagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4363 - RNA, 1576 nt, Artificial Sequence
  KX447516.1 solE mRNA Design 1 opt
gggagaaagcuuaccaugagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4364 - RNA, 1576 nt, Artificial Sequence
  KX447515.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4365 - RNA, 1576 nt, Artificial Sequence
  KU758874.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4366 - RNA, 1576 nt, Artificial Sequence
  KU729218.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4367 - RNA, 1576 nt, Artificial Sequence
  KU501217.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4368 - RNA, 1576 nt, Artificial Sequence
  KU761561.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4369 - RNA, 1576 nt, Artificial Sequence
  KY075937.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4370 - RNA, 1576 nt, Artificial Sequence
  KY014317.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4371 - RNA, 1576 nt, Artificial Sequence
  KU870645.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4372 - RNA, 1576 nt, Artificial Sequence
  KU922923.1 solE mRNA Design 1 opt
gggagaaagcuuaccaugagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4373 - RNA, 1576 nt, Artificial Sequence
  KU497555.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4374 - RNA, 1576 nt, Artificial Sequence
  KU312314.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4375 - RNA, 1576 nt, Artificial Sequence
  KY014314.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4376 - RNA, 1576 nt, Artificial Sequence
  KX447517.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4377 - RNA, 1576 nt, Artificial Sequence
  KU729217.2 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4378 - RNA, 1576 nt, Artificial Sequence
  KY328290.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4379 - RNA, 1576 nt, Artificial Sequence
  KX087101.3 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4380 - RNA, 1576 nt, Artificial Sequence
  KY003156.1 solE mRNA Design 1 opt
gggagaaagcuuaccaugagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4381 - RNA, 1576 nt, Artificial Sequence
  KU758876.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4382 - RNA, 1576 nt, Artificial Sequence
  KU926310.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4383 - RNA, 1576 nt, Artificial Sequence
  KU681081.3 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4384 - RNA, 1576 nt, Artificial Sequence
  KU744693.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4385 - RNA, 1576 nt, Artificial Sequence
  EU545988.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4386 - RNA, 1576 nt, Artificial Sequence
  KY007221.1 solE mRNA Design 1 opt
gggagaaagcuuaccaugagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4387 - RNA, 1576 nt, Artificial Sequence
  KY003152.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcgccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4388 - RNA, 1576 nt, Artificial Sequence
  KX694533.2 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4389 - RNA, 1576 nt, Artificial Sequence
  KX601167.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4390 - RNA, 1576 nt, Artificial Sequence
  KY288905.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4391 - RNA, 1576 nt, Artificial Sequence
  KF268950.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4392 - RNA, 1576 nt, Artificial Sequence
  KF383116.1 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4393 - RNA, 1558 nt, Artificial Sequence
  KU963574.2 solE mRNA Design 1 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4394 - RNA, 1576 nt, Artificial Sequence
  KF383118.1 solE mRNA Design 1 opt
gggagaaagcuuaccaugagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4395 - RNA, 1576 nt, Artificial Sequence
  KX520666.1 solE mRNA Design 1 opt
gggagaaagcuuaccaugagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4396 - RNA, 1576 nt, Artificial Sequence
  KF383120.1 solE mRNA Design 1 opt
gggagaaagcuuaccaugagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4397 - RNA, 2359 nt, Artificial Sequence
  ZIKV (strain ZikaSPH2015) Polyprotein(93-804) mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4398 - RNA, 2359 nt, Artificial Sequence
  ZIKV (isolate Z1106033) Polyprotein(93-804) mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaaugccaagaacgggagcaucucccugaugugucuugcucugggaggcguucucauuuuccugagcaccgccgugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4399 - RNA, 2347 nt, Artificial Sequence
  ZIKV (strain MR 766) Polyprotein(93-800) mRNA Design 1 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugaggacagagcuaagguggaggucacaccuaauagcccgcgcgcggaagccacccuuggcggcuucgggucccugggacucgauugugagccccggaccggccuggacuuuucugaucuuuauuaccugacaaugaacaauaaacacuggcucgugcauaaggaaugguuccacgacauuccucugcccuggcacgcuggggccgauaccggaacaccucauuggaacaauaaagaggcccuggucgaauuuaaggacgcucacgccaagagacagacggugguugugcucggcagccaggagggggcgguccauaccgcucuggccggcgcccuugaggcugaaauggauggagccaaaggccgccuguucuccgggcaccucaagugccggcugaaaauggacaaacuuagacugaagggagugagcuauucucucuguacagcugccuuuaccuucacaaagguucccgcggagacccugcauggcacggugaccgucgaagugcaguacgccgggacagacggaccgugcaagaucccugugcaaauggcuguugauaugcagacccugacacccgucggccgccucaucaccgccaacccugugauuacggaguccacagaaaauagcaaaaugaugcuggagcuugacccucccuuuggggauucuuacaucgugauuggcgucggagacaagaaaaucacccaccacuggcaucgguccggcagcacaauugggaaggcuuucgaggccaccgugagaggagcgaaacgcauggccguucugggcgauaccgcuugggacuucggguccgugggaggcgucuuuaacucucucgggaagggcauccaccagaucuucggagccgcuuuuaagagccuguucggcgggauguccugguuuucucaaauucugaucggaacacuucucguguggcugggccugaacacgaaaaaugggagcauuucccucaccugucuggcccuuggaggcguuaugaucuuccugagcacagccgugucugcugaugucgggugcuccguggacuuuagcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4400 - RNA, 2359 nt, Artificial Sequence
  ZIKV (strain NatalRGN) Polyprotein(93-804) mRNA Design 1 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4401 - RNA, 2284 nt, Artificial Sequence
  ZIKV (strain ZikaSPH2015) Polyprotein(108-794) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4402 - RNA, 2284 nt, Artificial Sequence
  ZIKV (isolate Z1106033) Polyprotein(108-794) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacgcuaagaauggcagcaucucccugaugugucuugcgcuugggggagugcucauuuuccugagcaccgccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4403 - RNA, 2272 nt, Artificial Sequence
  ZIKV (strain MR 766) Polyprotein(108-790) mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacaauuggcaaggcuuucgaggccaccgugcgcggggcuaaacggauggccguucugggagacaccgcgugggauuucggcuccgucgggggaguguuuaauucucucggcaaggggauccaccagauuuucggcgccgcuuuuaaaagccuguucggaggcauguccugguuuucucaaauccugaucgggacacuucucguguggcugggacugaacacgaagaacggcagcauuucccucaccugucuggcccuugggggaguuaugaucuuccugagcacagcugugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4404 - RNA, 2284 nt, Artificial Sequence
  ZIKV (strain NatalRGN) Polyprotein(108-794) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4405 - RNA, 1576 nt, Artificial Sequence
  ZIKV (strain ZikaSPH2015) Polyprotein(273-723) mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggauauuguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4406 - RNA, 1576 nt, Artificial Sequence
  ZIKV (isolate Z1106033) Polyprotein(273-723) mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgaaacgcauggcuguucucggggacacggccugggauuuuggaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4407 - RNA, 1564 nt, Artificial Sequence
  ZIKV (strain MR 766) Polyprotein(273-719) mRNA Design 1 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugaggaccgggccaagguugaagugaccccuaacagcccccgcgcugaggccacacucgggggauuuggcucucugggccuggauugcgagccuagaaccgggcuugacuucuccgaucuguacuaccucacgaugaauaacaaacauuggcuggugcacaaggaaugguuucaugacauuccccuuccuuggcacgcgggagccgacacaggcaccccgcacuggaauaacaaagaggcucuggucgaguucaaggaugcccaugcuaagcggcagacagugguugugcucgggagccaggaaggagccguccacaccgcgcuggccggcgcucuggaagccgagauggacggggcuaaaggacgccucuuuuccggccaucugaaguguagacuuaaaauggauaagcugcggcucaaaggcgugucuuauagccugugcaccgccgccuucacauuuacgaagguucccgcugagacccuucacgggacagugaccgucgaagugcaauacgcgggaacagacggcccuuguaaaauccccguccagauggccguggauaugcagacccugacgccuguugggcgccucauuacagcuaaucccgugaucaccgaguccaccgaaaacagcaagaugaugcuggagcuggacccgccuuucggagauucuuauauugucaucggcgugggggacaagaaaaucacacaccauuggcacagauccggcagcaccauuggaaaggccuuugaagccacaguucggggcgcuaaacgcauggccgugcucggggauacggcgugggacuucggaucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4408 - RNA, 1576 nt, Artificial Sequence; identical to SEQ ID NO: 4406
  ZIKV (strain NatalRGN) Polyprotein(273-723) mRNA Design 1 opt

SEQ ID NO: 4409 - RNA, 2284 nt, Artificial Sequence
  ZIKV (strain ZikaSPH2015) Polyprotein(108-794)(F398S) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagccucuauuuccgacauggcuagcgauuccagaugucccacgcaaggggaggcuuaccuggacaagcagucugacacccaguaugugugcaaacggacacucguugaucgcggauggggcaauggcugugggcugagcggaaagggcucccuggugaccugcgccaaauucgccugcagcaagaaaaugacagggaagucuauccagccugaaaaccucgaguacagaaucaugcuguccguccacggaagccaacacucuggcaugauugugaaugacaccgggcaugaaacggaugagaaccgggcuaagguugagaucacaccgaauagccccagagcggaagccacccuuggaggcuuuggcucccuggggcucgacugugagccucgcaccggacuggauuucucugaccuuuauuaccugacaaugaacaauaaacacuggcucgugcauaaggaaugguuucacgauauuccccugccuuggcacgcuggcgccgacaccgggacaccccauuggaacaauaaagaggcccuggucgaguucaaggaugcucacgccaaacggcagacgguggucgugcucggaagccaggaaggcgcgguucauaccgcucuggccggggcccuugaggcugaaauggacggcgccaagggaagacuguccagcggccaccucaaaugccgccugaagauggauaagcugcggcugaaaggggugucuuauucccucuguacagcugccuuuaccuucacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggagagcacagaaaacucuaagaugaugcuggagcuugaucccccuuuuggcgacuccuacaucguuauuggggucggcgagaaaaagaucacccaccacuggcaucgcagcggauccacaauuggcaaggccuucgaagcgaccgugagaggggccaaacggauggcugugcugggagauaccgccugggacuuuggcucugucgggggagcucucaauagccugggcaaggggauccaccagauuuucggcgccgccuucaaaucccuguuuggaggcaugucuugguucagccaaauccuuaucgggacacuccugauguggcugggacucaacacgaagaauggcuccauuagccugaugugucuugcucuugggggagugcucaucuuucugucuaccgcgguuuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4410 - RNA, 2284 nt, Artificial Sequence
  ZIKV (isolate Z1106033) Polyprotein(108-794)(F398S) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagccucuaucuccgacauggcuagcgauuccagaugucccacccaaggggaggcuuaccuggacaagcagucugacacacaguauguuugcaaacggacccucguggaucgcggauggggcaauggcugugggcugagcggaaagggcucccuggucacaugcgccaaauucgccugcagcaagaaaaugaccgggaagucuauucagccugaaaaccucgaguacagaaucaugcuguccgugcacggaagccaacacucuggcaugaucguuaaugacacggggcaugaaacagaugagaaccgggcuaagguggagauuaccccgaauagccccagagcggaagccacccuuggaggcuuuggcucccuggggcucgacugugagccucgcacaggacuggauuucucugaccuuuauuaccugaccaugaacaauaaacacuggcucguccauaaggaaugguuucacgauaucccccugccuuggcacgcuggcgccgacacagggacgccccauuggaacaauaaagaggcccugguggaguucaaggaugcucacgccaaacggcagaccgucgugguucucggaagccaggaaggcgcggugcauacagcucuggccggggcccuugaggcugaaauggacggcgccaagggaagacuguccagcggccaccucaaaugccgccugaagauggauaagcugcggcugaaaggggucucuuauucccucuguaccgcugccuuuacauucaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagagcaccgaaaacucuaagaugaugcuggagcuugaucccccuuuuggcgacuccuacaucgucaucggggugggcgagaaaaagauuacacaccacuggcaucgcagcggauccaccaucggcaaggccuucgaagcgaccgugagaggggccaaacggauggcuguccugggagauacagccugggacuuuggcucuguugggggagcucucaauagccugggcaaggggauucaccagaucuucggcgccgccuucaaaucccuguuuggaggcaugucuugguucagccaaauucuuaucgggacgcuccugauguggcugggacucaacgcuaagaauggcuccaucagccugaugugucuugcgcuugggggagugcucauuuuucugucuaccgccguguccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4411 - RNA, 2272 nt, Artificial Sequence
  ZIKV (strain MR 766) Polyprotein(108-790)(F398S) mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguccggaaagggcagccuggugaccugcgcuaaauucacaugcucuaagaagaugaccgggaaauccauccagcccgagaaucucgaauaucgcauuaugcugagcguucacggaucucaacauagcggcaugaucggguacgagacggacgaagauagagccaagguggaggucacaccuaacuccccgcgggccgaggcuacccuuggaggcuuuggcucucuggggcucgacugugaacccagaaccggacuggauuucagcgaccuuuauuaccugacaaugaauaacaaacacuggcucgugcauaaggagugguuucacgauauuccucugcccuggcacgcgggcgccgacaccgggacaccucauuggaauaacaaagaagcucuggucgaguucaaggaugcccacgccaaacgccagacggugguugugcucggaucccaggaaggcgcuguccauaccgcccuggcgggggcucuugaggccgagauggacggcgccaagggacggcuguuuagcggccaccucaagugcagacugaaaauggauaaacuucgccugaagggggugucuuauucccucuguacagcugccuucaccuuuacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaaagcacagagaacucuaagaugaugcuggaacuugauccucccuucggcgacuccuacaucgugauuggggucggcgauaagaaaaucacccaccacuggcauagaagcggauccacaauuggcaaggcuuuugaggccaccgugcgcggggcuaaacggauggccguucugggagacaccgcgugggauuucggcucugucgggggaguguucaauagccucggcaaggggauccaccagauuuuuggcgccgcuuucaaaucccuguuuggaggcaugucuugguucagccaaauccugaucgggacacuucucguguggcugggacugaacacgaagaacggcuccauuagccucaccugucuggcccuugggggaguuaugaucuuucugucuacagcuguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4412 - RNA, 2284 nt, Artificial Sequence
  ZIKV (strain NatalRGN) Polyprotein(108-794)(F398S) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcugagcggaaagggcucccuggugaccugcgccaaauucgccugcagcaagaaaaugacagggaagucuauucagccugaaaaccucgaguacagaaucaugcuguccgugcacggaagccaacacucuggcaugaucguuaaugacaccgggcaugaaacggaugagaaccgggcuaagguggagauuacaccgaauagccccagagcggaagccacccuuggaggcuuuggcucccuggggcucgacugugagccucgcaccggacuggauuucucugaccuuuauuaccugacaaugaacaauaaacacuggcucguccauaaggaaugguuucacgauaucccccugccuuggcacgcuggcgccgacaccgggacaccccauuggaacaauaaagaggcccugguggaguucaaggaugcucacgccaaacggcagacggucgugguucucggaagccaggaaggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuuuaccuucacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggagagcacagaaaacucuaagaugaugcuggagcuugaucccccuuuuggcgacuccuacaucgucaucggggugggcgagaaaaagauuacccaccacuggcaucgcagcggauccacaaucggcaaggccuucgaagcgaccgugagaggggccaaacggauggcuguccugggagauaccgccugggacuuuggcucugucgggggagcucucaauagccugggcaaggggauucaccagaucuucggcgccgccuucaaaucccuguuuggaggcaugucuugguucagccaaauucuuaucgggacacuccugauguggcugggacucaacacgaagaauggcuccaucagccugaugugucuugcucuugggggaguucucauuuuucugucuaccgcgguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4413 - RNA, 2284 nt, Artificial Sequence
  ZIKV (strain ZikaSPH2015) Polyprotein(108-794)(N444Q) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugcaggacaccgggcaugaaacggaugagaaucgggcuaagguugagaucacaccgaacucucccagagcggaagccacccuuggaggcuucggcagccuggggcucgacugugagccucgcaccggacuggauuuuuccgaccuuuauuaccugacaaugaauaacaaacacuggcucgugcauaaggaaugguuccacgauauuccccugccuuggcacgcuggcgccgacaccgggacaccccauuggaauaacaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaauacgccggcacagacgggccuugcaaagugcccgcucagauggccgucgacaugcagacccugacaccugugggaagacucauuaccgcuaaucccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaacucucugggcaaggggauccaccaaauuuucggcgccgccuuuaaaagccuguucggaggcauguccugguuuucucagauccuuaucgggacacuccugauguggcugggacucaauacgaagaacggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4414 - RNA, 2284 nt, Artificial Sequence
  ZIKV (isolate Z1106033) Polyprotein(108-794)(N444Q) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguucaggacacggggcaugaaacagaugagaaucgggcuaagguggagauuaccccgaacucucccagagcggaagccacccuuggaggcuucggcagccuggggcucgacugugagccucgcacaggacuggauuuuuccgaccuuuauuaccugaccaugaauaacaaacacuggcucguccauaaggaaugguuccacgauaucccccugccuuggcacgcuggcgccgacacagggacgccccauuggaauaacaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaauacgccggcaccgacgggccuugcaaaguccccgcucagauggccguggacaugcagacacugaccccugugggaagacucaucacggcuaaucccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaacucucugggcaaggggauucaccaaaucuucggcgccgccuuuaaaagccuguucggaggcauguccugguuuucucagauucuuaucgggacgcuccugauguggcugggacucaaugcuaagaacggcagcaucucccugaugugucuugcgcuugggggagugcucauuuuccugagcaccgccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4415 - RNA, 2284 nt, Artificial Sequence
  ZIKV (strain NatalRGN) Polyprotein(108-794)(N444Q) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguucaggacaccgggcaugaaacggaugagaaucgggcuaagguggagauuacaccgaacucucccagagcggaagccacccuuggaggcuucggcagccuggggcucgacugugagccucgcaccggacuggauuuuuccgaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggaagacucaucaccgcuaaucccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaacucucugggcaaggggauucaccaaaucuucggcgccgccuuuaaaagccuguucggaggcauguccugguuuucucagauucuuaucgggacacuccugauguggcugggacucaauacgaagaacggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4416 - RNA, 2284 nt, Artificial Sequence
  ZIKV (strain ZikaSPH2015) Polyprotein(108-694)-Cterm-JAEV1-E(400-500) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaaacuucggcugaagggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacacugggcaaggccuuuuccaccacccucaaaggggcgcagcggcuggccgcucugggagauacagccugggacuucggcucuauugggggaguguucaauagcaucggcagagcugugcaccaagucuuugggggcgccuuccgcacgcuuuuuggaggcauguccuggauuacccaggggcucaugggagcccugcugcucuggaugggcgugaacgcucgggauagaucuaucgcgcuggccuuccuugcuacagggggaguucugguguuucucgccaccaauguccaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4417 - RNA, 2284 nt, Artificial Sequence
  ZIKV (isolate Z1106033) Polyprotein(108-694)-Cterm-JAEV1-E(400-500) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaaacuucggcugaagggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcacccugggcaaggccuuuuccaccacacucaaaggggcgcagcggcuggccgcucugggagauacggccugggacuucggcucuaucgggggaguguucaauagcauuggcagagcuguccaccaaguguuugggggcgccuuccgcacccuuuuuggaggcauguccuggaucacacaggggcucaugggagcccugcugcucuggaugggcguuaacgcucgggauagaucuauugcgcuggccuuccuugcuaccgggggagugcuggucuuucucgccacaaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4418 - RNA, 2272 nt, Artificial Sequence
  ZIKV (strain MR 766) Polyprotein(108-690)-Cterm-JAEV1-E(400-500) mRNA Design 1 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacacugggcaaggcuuucuccaccacccucaaaggggcccagcgccuggcugcccugggagacacagcgugggauuucggcucuauugggggaguguuuaauagcaucggccgggccguucaccaaguguucgggggcgcuuuuagaacgcuuuucggaggcauguccuggauuacccaggggcucaugggagcccugcugcucuggaugggcgucaacgcucgcgaccggucuaucgcccuggccuuucuugcuacagggggagugcugguuuuccucgcgaccaacgugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4419 - RNA, 2284 nt, Artificial Sequence
  ZIKV (strain NatalRGN) Polyprotein(108-694)-Cterm-JAEV1-E(400-500) mRNA Design 1 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaaacuucggcugaagggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacacugggcaaggccuuuuccaccacccucaaaggggcgcagcggcuggccgcucugggagauacagccugggacuucggcucuaucgggggaguguucaauagcauuggcagagcuguccaccaaguguuugggggcgccuuccgcacgcuuuuuggaggcauguccuggaucacccaggggcucaugggagcccugcugcucuggaugggcguuaacgcucgggauagaucuauugcgcuggccuuccuugcuacagggggagugcuggucuuucucgccaccaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4420 - RNA, 2359 nt, Artificial Sequence; identical to SEQ ID NO: 4397
  ZIKV (strain ZikaSPH2015) Polyprotein(93-804) mRNA Design 1 opt
